US006958214B2

(12) United States Patent
Braun

(10) Patent No.: US 6,958,214 B2
(45) Date of Patent: Oct. 25, 2005

(54) POLYMORPHIC KINASE ANCHOR PROTEINS AND NUCLEIC ACIDS ENCODING THE SAME

(75) Inventor: Andreas Braun, San Diego, CA (US)

(73) Assignee: Sequenom, Inc., San Diego, CA (US)

( * ) Notice: Subject to any disclaimer, the term of this patent is extended or adjusted under 35 U.S.C. 154(b) by 0 days.

(21) Appl. No.: 09/834,700

(22) Filed: Apr. 12, 2001

(65) Prior Publication Data

US 2002/0040130 A1 Apr. 4, 2002

Related U.S. Application Data

(60) Provisional application No. 60/217,251, filed on Jul. 10, 2000, and provisional application No. 60/240,335, filed on Oct. 13, 2000.

(51) Int. Cl.[7] .......................... C07H 21/04; C12Q 1/68
(52) U.S. Cl. ....................... 435/6; 435/91.1; 435/91.2; 435/320.1; 435/325; 435/69.1; 536/23.1; 536/24.3; 536/23.4; 536/24.31; 536/24.33
(58) Field of Search ............................. 536/23.1, 23.4, 536/24.3, 24.31, 24.33; 435/6, 91.2, 69.1, 320.1, 325, 174

(56) References Cited

U.S. PATENT DOCUMENTS

| | | | |
|---|---|---|---|
| 3,687,808 A | 8/1972 | Merigan, Jr. et al. ...... 195/28 N |
| 3,817,837 A | 6/1974 | Rubenstein et al. .. 195/103.5 R |
| 3,850,752 A | 11/1974 | Schuurs et al. .......... 195/103.5 |
| 3,939,350 A | 2/1976 | Kronick et al. ............. 250/365 |
| 3,996,345 A | 12/1976 | Ullman et al. ................ 424/12 |
| 4,076,982 A | 2/1978 | Ritter et al. ................. 250/288 |
| 4,275,149 A | 6/1981 | Litman et al. .................. 435/7 |
| 4,277,437 A | 7/1981 | Maggio ........................ 422/61 |
| 4,366,241 A | 12/1982 | Tom et al. ...................... 435/7 |
| 4,511,503 A | 4/1985 | Olson et al. ............. 260/112 R |
| 4,568,649 A | 2/1986 | Bertoglio-Matte .......... 436/534 |
| 4,656,127 A | 4/1987 | Mundy ........................... 435/6 |
| 4,683,195 A | 7/1987 | Mullis et al. ................... 435/6 |
| 4,683,202 A | 7/1987 | Mullis ......................... 435/91 |
| 4,722,848 A | 2/1988 | Paoletti et al. ................ 424/89 |
| 4,826,360 A | 5/1989 | Iwasawa et al. ............. 406/51 |
| 4,851,018 A | 7/1989 | Lazzari et al. ................ 55/356 |
| 4,981,957 A | 1/1991 | Lebleu et al. ................. 536/27 |
| 4,987,071 A | 1/1991 | Cech et al. .................... 435/91 |
| 4,998,617 A | 3/1991 | Ladd, Jr. et al. ............. 206/219 |
| 5,013,830 A | 5/1991 | Ohtsuka et al. ............... 536/27 |
| 5,025,939 A | 6/1991 | Bunn et al. .................. 215/100 |
| 5,034,506 A | 7/1991 | Summerton et al. ......... 528/391 |
| 5,118,800 A | 6/1992 | Smith et al. ................... 536/23 |
| 5,118,937 A | 6/1992 | Hillenkamp et al. .......... 250/59 |
| 5,122,342 A | 6/1992 | McCulloch et al. ........... 422/65 |
| 5,149,797 A | 9/1992 | Pederson et al. .............. 536/27 |
| 5,166,315 A | 11/1992 | Summerton et al. ......... 528/406 |
| 5,175,430 A | 12/1992 | Enke et al. .................. 250/282 |
| 5,185,444 A | 2/1993 | Summerton et al. .......... 544/81 |
| 5,214,134 A | 5/1993 | Weis et al. ................. 536/25.3 |
| 5,216,141 A | 6/1993 | Benner ..................... 536/27.13 |
| 5,220,007 A | 6/1993 | Pederson et al. ........... 536/23.1 |
| 5,235,033 A | 8/1993 | Summerton et al. ......... 528/391 |
| 5,247,175 A | 9/1993 | Schoen et al. ............... 250/281 |
| 5,256,775 A | 10/1993 | Froehler ..................... 536/25.6 |
| 5,259,044 A | 11/1993 | Isono et al. ..................... 385/2 |
| 5,264,562 A | 11/1993 | Matteucci ................... 536/23.1 |
| 5,264,564 A | 11/1993 | Matteucci ................... 536/23.1 |
| 5,273,718 A | 12/1993 | Sköld et al. ................. 422/101 |
| 5,283,173 A | 2/1994 | Fields et al. .................... 435/6 |
| 5,319,080 A | 6/1994 | Leumann ................... 536/27.1 |
| 5,363,885 A | 11/1994 | McConnell et al. ............ 141/1 |
| 5,366,878 A | 11/1994 | Pederson et al. .......... 435/91.3 |
| 5,393,878 A | 2/1995 | Leumann ................... 436/28.2 |
| 5,403,711 A | 4/1995 | Walder et al. .................. 435/6 |
| 5,405,938 A | 4/1995 | Summerton et al. ......... 528/406 |
| 5,434,257 A | 7/1995 | Matteucci et al. .......... 536/24.3 |
| 5,436,150 A | 7/1995 | Chandrasegaran .......... 435/199 |
| 5,440,119 A | 8/1995 | Labowsky ................... 260/282 |
| 5,446,137 A | 8/1995 | Maag et al. ................. 536/23.1 |
| 5,453,613 A | 9/1995 | Gray et al. .................. 250/281 |
| 5,466,677 A | 11/1995 | Baxter et al. ................. 514/44 |
| 5,466,786 A | 11/1995 | Buhr et al. ............... 536/26.26 |
| 5,470,967 A | 11/1995 | Huie et al. .................. 536/24.3 |
| 5,474,796 A | * 12/1995 | Brennan ..................... 427/2.13 |
| 5,489,677 A | 2/1996 | Sanghvi et al. ............. 536/22.1 |
| 5,491,133 A | 2/1996 | Walder et al. ................. 514/44 |
| 5,492,806 A | 2/1996 | Drmanac et al. ............... 435/6 |
| 5,498,545 A | 3/1996 | Vestal .......................... 436/47 |
| 5,503,980 A | 4/1996 | Cantor .......................... 435/6 |
| 5,506,137 A | 4/1996 | Mathur et al. ........... 435/252.3 |
| 5,514,785 A | 5/1996 | Van Ness et al. .......... 536/22.1 |
| 5,519,134 A | 5/1996 | Acevedo et al. ............. 544/243 |

(Continued)

FOREIGN PATENT DOCUMENTS

| | | |
|---|---|---|
| EP | 0596205 A3 | 5/1994 |
| EP | 0596205 A2 | 5/1994 |
| FR | 2650840 A1 | 11/1989 |
| FR | 2749662 A1 | 6/1996 |

(Continued)

OTHER PUBLICATIONS

Huang et al. "D–AKAP2, a novel protein kinase A anchoring protein with a putative RGS domain." PNAS, vol. 94, pp. 11184–11189, Oct. 1997.*

Genbank Accession No. AC005730, Birren et al. "homo sapiens chromosome 17" Oct. 1998.*

(Continued)

*Primary Examiner*—Jeanine A. Goldberg
(74) *Attorney, Agent, or Firm*—Bruce D. Grant; Biotechnology Law Group

(57) ABSTRACT

Polymorphic A-kinase anchor proteins (AKAPs) and nucleic acids encoding the proteins are provided herein. Methods of detecting polymorphic AKAPs and nucleic acids encoding the AKAPs, and kits for use in the detection methods are also provided. Further provided herein are methods of identifying subjects having or at risk of developing disorders of signal transduction. Methods of determining susceptibility to morbidity and/or increased or early mortality are also provided.

15 Claims, No Drawings

U.S. PATENT DOCUMENTS

| | | |
|---|---|---|
| 5,525,464 A | 6/1996 | Drmanac et al. .............. 435/6 |
| 5,536,649 A | 7/1996 | Fraiser et al. .............. 435/91.2 |
| 5,541,307 A | 7/1996 | Cook et al. ................. 536/23.1 |
| 5,547,835 A | 8/1996 | Koster ............................ 435/6 |
| 5,561,225 A | 10/1996 | Maddry et al. ............ 536/23.1 |
| 5,565,350 A | 10/1996 | Kmiec ..................... 435/172.3 |
| 5,567,811 A | 10/1996 | Misiura et al. .......... 536/25.34 |
| 5,571,676 A | 11/1996 | Shuber ........................... 435/6 |
| 5,576,427 A | 11/1996 | Cook et al. ................. 536/23.1 |
| 5,580,732 A | 12/1996 | Grossman et al. ............. 435/6 |
| 5,591,722 A | 1/1997 | Montgomery et al. ........ 514/45 |
| 5,593,826 A | 1/1997 | Fung et al. ..................... 435/6 |
| 5,596,086 A | 1/1997 | Matteucci et al. ......... 536/22.1 |
| 5,597,909 A | 1/1997 | Urdea et al. ............... 536/24.3 |
| 5,602,240 A | 2/1997 | De Mesmaeker et al. . 536/22.1 |
| 5,604,098 A | 2/1997 | Mead et al. .................... 435/6 |
| 5,605,798 A | 2/1997 | Köster ........................... 435/6 |
| 5,608,046 A | 3/1997 | Cook et al. ................. 536/23.1 |
| 5,610,289 A | 3/1997 | Cook et al. ............... 536/25.34 |
| 5,610,300 A | 3/1997 | Altmann et al. ............ 544/244 |
| 5,618,704 A | 4/1997 | Sanghvi et al. ............. 435/91.5 |
| 5,622,824 A | 4/1997 | Köster ........................... 435/6 |
| 5,623,065 A | 4/1997 | Cook et al. ................. 536/23.1 |
| 5,623,070 A | 4/1997 | Cook et al. ................. 536/27.6 |
| 5,627,053 A | 5/1997 | Usman et al. .............. 435/91.1 |
| 5,631,134 A | 5/1997 | Cantor ........................... 435/6 |
| 5,633,360 A | 5/1997 | Bischofberger et al. ... 536/22.1 |
| 5,639,873 A | 6/1997 | Barascut et al. ............ 536/25.3 |
| 5,646,265 A | 7/1997 | McGee .................... 536/25.34 |
| 5,652,355 A | 7/1997 | Metelev et al. ............ 536/24.5 |
| 5,652,356 A | 7/1997 | Agrawal ..................... 536/245 |
| 5,658,873 A | 8/1997 | Bertsch-Frank et al. .... 510/375 |
| 5,663,312 A | 9/1997 | Chaturvedula ............. 536/22.1 |
| 5,670,633 A | 9/1997 | Cook et al. ................. 536/23.1 |
| 5,677,437 A | 10/1997 | Teng et al. ................. 536/23.1 |
| 5,677,439 A | 10/1997 | Weis et al. ................. 536/23.1 |
| 5,691,141 A | 11/1997 | Köster ........................... 435/6 |
| 5,695,940 A | 12/1997 | Drmanac et al. .............. 435/6 |
| 5,700,672 A | 12/1997 | Mathur et al. .............. 435/183 |
| 5,700,920 A | 12/1997 | Altmann et al. ............ 536/221 |
| 5,714,330 A | 2/1998 | Brenner et al. ................. 435/6 |
| 5,777,324 A | 7/1998 | Hillenkamp ................ 250/288 |
| 5,795,714 A | 8/1998 | Cantor et al. ................... 435/6 |
| 5,834,189 A | 11/1998 | Stevens et al. ................. 435/6 |
| 5,837,832 A | 11/1998 | Chee et al. ................. 536/22.1 |
| 5,843,669 A | 12/1998 | Kaiser et al. ................... 435/6 |
| 5,851,765 A | 12/1998 | Köster ........................... 435/6 |
| 5,856,092 A | 1/1999 | Dale et al. ...................... 435/6 |
| 5,858,659 A | 1/1999 | Sapolsky et al. ............... 435/6 |
| 5,858,705 A | 1/1999 | Wei et al. ................... 435/69.1 |
| 5,869,242 A | 2/1999 | Kamb ............................ 435/6 |
| 5,869,275 A | 2/1999 | Huang ......................... 435/15 |
| 5,871,911 A | 2/1999 | Dahlberg et al. ............... 435/6 |
| 5,872,003 A | 2/1999 | Köster ..................... 435/283.1 |
| 5,874,283 A | 2/1999 | Harrington et al. ...... 435/252.3 |
| 5,876,934 A | 3/1999 | Duthie et al. ................... 435/6 |
| 5,885,841 A | 3/1999 | Higgs, Jr. et al. ............. 436/89 |
| 5,888,795 A | 3/1999 | Hamilton ................... 435/200 |
| 5,900,481 A | 5/1999 | Lough et al. ............... 536/55.3 |
| 5,908,755 A | 6/1999 | Kumar et al. ................... 435/6 |
| 5,912,118 A | 6/1999 | Ansorge et al. ................ 435/6 |
| 5,928,870 A | 7/1999 | Lapidus et al. ................. 435/6 |
| 5,928,906 A | 7/1999 | Köster et al. .............. 435/91.2 |
| 5,928,952 A | 7/1999 | Hutchins et al. ............. 436/50 |
| 5,952,174 A | 9/1999 | Nikiforov et al. .............. 435/6 |
| 5,952,176 A | 9/1999 | McCarthy et al. ............. 435/6 |
| 5,976,802 A | 11/1999 | Ansorge et al. ................ 435/6 |
| 5,976,806 A | 11/1999 | Mahajan et al. ............... 435/6 |
| 5,981,186 A | 11/1999 | Gabe et al. ..................... 435/6 |
| 5,985,214 A | 11/1999 | Stylli et al. ................... 422/65 |
| 5,998,143 A | 12/1999 | Ellis et al. ...................... 435/6 |
| 6,004,744 A | 12/1999 | Goelet et al. ................... 435/5 |
| 6,013,431 A | 1/2000 | Soderlund et al. ............. 435/5 |
| 6,017,693 A | 1/2000 | Yates, III et al. ............... 435/5 |
| 6,017,702 A | 1/2000 | Lee et al. ....................... 435/6 |
| 6,018,041 A | 1/2000 | Drmanac et al. .......... 536/24.3 |
| 6,020,122 A | 2/2000 | Okasinski et al. ............. 435/5 |
| 6,022,688 A | 2/2000 | Jurinke et al. .................. 435/6 |
| 6,024,925 A | 2/2000 | Little et al. .................. 422/100 |
| 6,025,136 A | 2/2000 | Dramanac ...................... 435/6 |
| 6,030,778 A | 2/2000 | Acton et al. .................... 435/6 |
| 6,043,031 A | 3/2000 | Koster et al. ................... 435/6 |
| 6,043,136 A | 3/2000 | Jang et al. .................. 438/424 |
| 6,046,005 A | 4/2000 | Ju et al. .......................... 435/6 |
| 6,054,276 A | 4/2000 | Macevicz ....................... 435/6 |
| 6,060,022 A | 5/2000 | Pang et al. .................... 422/65 |
| 6,074,823 A | 6/2000 | Köster ........................... 435/6 |
| 6,087,095 A | 7/2000 | Rosenthal et al. .............. 435/6 |
| 6,090,606 A | 7/2000 | Kaiser et al. ................ 435/199 |
| 6,099,553 A | 8/2000 | Hart et al. .................. 606/232 |
| 6,111,251 A | 8/2000 | Hillenkamp ................ 250/288 |
| 6,117,634 A | 9/2000 | Langmore et al. ............. 435/6 |
| 6,132,685 A | 10/2000 | Kercso et al. ............... 422/104 |
| 6,133,436 A | 10/2000 | Köster et al. .............. 536/24.3 |
| 6,133,502 A | 10/2000 | Kasuga et al. ................ 800/14 |
| 6,140,053 A | 10/2000 | Köster ........................... 435/6 |
| 6,146,854 A | 11/2000 | Köster et al. .............. 435/91.1 |
| 6,147,344 A | 11/2000 | Annis et al. ................. 250/281 |
| 6,156,501 A | 12/2000 | McGall et al. ................. 435/6 |
| 6,175,057 B1 | 1/2001 | Mucke et al. ................ 800/12 |
| 6,180,849 B1 | 1/2001 | Strculi et al. ................. 800/18 |
| 6,197,498 B1 | 3/2001 | Köster ........................... 435/5 |
| 6,221,601 B1 | 4/2001 | Köster et al. ................... 435/6 |
| 6,221,605 B1 | 4/2001 | Köster ........................... 435/6 |
| 6,235,478 B1 | 5/2001 | Köster ........................... 435/6 |
| 6,262,334 B1 * | 7/2001 | Endege et al. ................. 800/8 |
| 6,294,328 B1 * | 9/2001 | Fleischmann et al. ......... 435/6 |

FOREIGN PATENT DOCUMENTS

| | | |
|---|---|---|
| WO | 9102087 | 2/1991 |
| WO | 9113075 | 9/1991 |
| WO | 9116457 | 10/1991 |
| WO | 9215712 | 9/1992 |
| WO | 9315407 | 8/1993 |
| WO | 9415219 | 7/1994 |
| WO | 9416101 | 7/1994 |
| WO | 9421822 | 9/1994 |
| WO | 9525281 | 9/1995 |
| WO | 9629431 | 9/1996 |
| WO | 9703210 | 1/1997 |
| WO | 9708306 | 3/1997 |
| WO | 9737041 | 10/1997 |
| WO | 9742348 | 11/1997 |
| WO | 9743617 | 11/1997 |
| WO | 9747974 | 12/1997 |
| WO | 9812734 | 3/1998 |
| WO | 9820019 | 5/1998 |
| WO | 9820020 | 5/1998 |
| WO | 9820166 | 5/1998 |
| WO | 9830883 | 7/1998 |
| WO | 9833808 | 8/1998 |
| WO | 9835609 | 8/1998 |
| WO | 9856954 | 12/1998 |
| WO | 9909218 | 2/1999 |
| WO | 9912040 | 3/1999 |
| WO | 9931278 | 6/1999 |
| WO | 9950447 | 10/1999 |
| WO | 9954501 | 10/1999 |
| WO | 9957318 | 11/1999 |
| WO | 0031300 | 6/2000 |
| WO | 0056446 | 9/2000 |

| | | |
|---|---|---|
| WO | 0058516 | 10/2000 |
| WO | 0058519 | 10/2000 |
| WO | 0060361 | 10/2000 |
| WO | 0127857 A2 | 4/2001 |

OTHER PUBLICATIONS

Genbank Accession No. AA349877, Adams et al. "Infant brain Homo sapiens cDNA," Apr. 1997.*

Genbank Accession No. AA331406. Adams et al. "Embryo, 8 week I homo sapiens cDNA," Apr. 21, 1997.*

Ahern (The Scientist. vol. 9, No. 15, p. 20, Jul. 1995).*

Chatterjee et al. Genbank Accession No. AF037439, Dec. 1997.*

Kwok. NCBI Single Nucleotide Polymorphism, rs2034632, ss266958, Jun. 30, 2000.*

*A Practical Guide To Molecular Cloning*, Book: Perbal B., John Wiley & Sons, New York, 1984.

Altschul et al., "Basic Local Alignment Search Tool", *J. Mol. Biol., 215*:403–410, (1990).

*Antibodies*, Book: A Lboratory Manual, Harlow, E. and Lane D., Cold Spring Harbor Laboratory, 1988.

Arrand et al., "Different Substrate Specificities of the Two DNA Ligases of Mammalian Cells", *J. Biol. Chem., 261(20)*:9079–9082, (1986).

Badger et al., "New features and enhancements in the X–PLOR computer program", *Proteins: Structure, Function, and Genetics, 35(1)*:25–33, (1999).

Beck et al., "Chemiluminescent detection of DNA: application for DNA sequencing and hybridization", *Nucl. Acids Res., 17(13)*:5115–5123, (1989).

Bertina et al., "Mutation in blood coagulation factor V associated with resistance to activated protein C", *Nature, 369*:64–67, (1994).

Bessho et al., "Nucleotide excision repair 3' endonuclease XPG stimulates the activity of base excision repair enzyme thymine glycol DNA glycosylase", *Nucl. Acids Res., 27(4)*:79–83, (1999).

Biernat et al., "The construction and cloning of synthetic genes coding for artificial proteins and expression studies to obtain fusion proteins", *Protein Engineering, 1(4)*:345–351, (1997).

*Biocomputing*, "Informatics and Genome Projects", Smith, W.D. (Ed.), Academic Press, Inc. San Diego, California (1994).

*Biological Techniques Series*, Book: "Immunochemical Methods in Cell and Molecular Biology", Mayer, R.J. and Walker, J.H., Academic Press, San Diego, Callifornia, 1987.

Bjelland, S. and Seeberg, E., "Purification and characterization of 3–methyladenine DNA glycosylase I from *Escherichia coli*", *Nucl. Acids Res., 15(7)*:2787–2800, (1987).

Bleczinski, C. and Richert, C., "Monitoring the Hybridization of the Components of Oligonucleotide Mixtures to Immobilized DNA via Matrix–assisted Laser Desorption/Ionization Time–of–flight Mass Spectrometry", *Rapid Communications in Mass Spectrometry, 12*:1737–1743, (1998).

Bosworth, N. and Towers, P., "Scintillation proximity assay", *Nature, 341*:167–168, (1989).

Boudet et al., "UV–treated polystyrene microtitre plates for use in an ELISA to measure antibodies against synthetic peptides", *J. Immunol. Meth., 142*:73–82, (1991).

Braun et al., "Detecting CFTR gene mutations by using primer oligo base extension and mass spectrometry", *Clin. Chem., 43(7)*:1151–1158, (1997).

Braun et al., "Improved Analysis of Microsatellites Using Mass Spectrometry", *Genomics, 46*:18–23, (1997).

Bregman et al., "Molecular Characterization of Bovine Brain P75, a High Affinity Binding Protein for the Regulatory Subunit of cAMP–dependent Protein Kinase IIβ", *J. Biol. Chem., 266(11)*:7207–7213, (1991).

Brinster et al., "Expression of a microinjected immunoglobulin gene in the splean of transgenic mice", *Nature, 306*:332–336, (1983).

Buetow et al., "High–throughput development and characterization of a genomewide collection of gene–based single nucleotide polymorphism markers by chip–based matrix–assisted laser desorption/ionization time–of–flight mass spectrometry", *Proc. Natl. Acad. Sci. USA, 98(2)*:581–584, (2001).

Burton et al., "Type II regulatory subunits are not required for the anchoring–dependent modulation of $CA^{2+}$ channel activity by cAMP–dependent protein kinase", *Proc. Natl. Acad. Sci. USA, 94*:11067–11072, (1997).

Carr et al., "Association of the Type II cAMP–dependent Protein Kinase with a Human Thyroid RII–anchoring Protein", *J. Biol. Chem., 267(19)*:13376–13382, (1992).

Carr et al., "Interaction of the Regulatory Subunit (RII) of cAMP–dependent Protein Kinase with RII–anchoring Protein Occurs through an Amphipathic Helix Binding Mofit", *J. Biol. Chem., 266(22)*:14188–14192, (1991).

Carrillo et al., "The Multiple Sequence Alignment Problem in Biology", *SIAM J. Appl. Math., 48(5)*:1073–1082, (1988).

Chiu et al., "Mass Spectrometry of Nucleic Acids", *Clin. Chem., 45*:1578, (1999).

Chiu et al., "Mass Spectrometry of single–stranded restriction fragments captured by an undigested complementary sequence", *Nucl. Acids. Res., 28(8)*:e31(i–iv), (2000).

Clegg et al., "Genetic characterization of a brain–specific form of the type I regulatory subunit of cAMP–dependent protein kinase", *Proc. Natl. Acad. Sci. USA, 85*:3703–3707, (1988).

Coghlan et al., "Association of Protein Kinase A and Protein Phosphatase 28 with a Common Anchoring Protein", *Science, 267*:108–111, (1995).

Cohen et al., "Emerging Technologies for Sequencing Antisense Oligonucleotides: Capillary Electrophoresis and Mass Spectrometry," *Advanced Chromatography, 36*:127–162, (1996).

Colledge, M. and Scott, J.D., "AKAPs: from structure to function", *Trends in Cell Biology, 9*:216–221, (1999).

*Computational Molecular Biology*, Book: "Sources and Methods for Sequence Analysis", Lesk, A.M. (Ed.), Oxford Univesity Press, New York (1988).

Corder et al., "Gene Dose of Apolipoprotein E Type 4 Allele and the Risk of Alzheimer's Disease in Late Onset Families", *Science, 261*:921–923, (1993).

Costantini, F. and Lacy, E., "Introduction of a rabbit β–globin gene into the mouse germ line", *Nature, 294*:92–94, (1981).

Cotton, R.G.H., "Current methods of mutation detection", *Mutation Res., 285*:125–144, (1993).

Cotton et al., "Reactivity of cytosine and thymine in single–base–pair mismatches with hydroxylamine and osmium tetroxide and its application to the study of mutations", *Proc. Natl. Acad. Sci. USA, 85*:4397–4401, (1988).

Cronin et al., "Cystic fibrosis mutation detection by hybridization to light–generated DNA probe arrays", *Hum. Mutat., 7*:244–255, (1996).

*Culture of Animal Cells*, A Manual of Basic Technique, Book: 2nd Edition, Freshney, R.I., Alan R. Liss, Inc., New York.

*Current Communications in Molecular Biology*, Book: Gene Transfer Vectors for Mammalian Cells, Cold Spring Harbor Laboratory, New York, 1987.

*Current Protocols In Immunology*, Book: vol. 4, Coligan, J.E. et al. (Eds.), John Wiley & Sons, Inc. New York, 1994.

Database WPI, Derwent publication #011635345 citing International Patent Application WO 9747974 of the parent French Patent Application FR 2,749,662.

Devereux, et al., "A comprehensive set of sequence analysis programs for the VAX", *Nucl. Acids Res., 12(1)*:387–395, (1984).

*DNA cloning*, a practical approach, Book: vol. II, Glover, D.M. (Ed.), IRL Press, Oxford, Washington DC (1985).

Eftedal et al., "Consensus sequences for good and poor removal or uracil from double stranded DNA by uracil–DNA glycosylase", *Nucl. Acids Res., 21(9)*:2095–2101, (1993).

Englisch, U. and Gauss, D.H., "Angewandte Chemie", *Angew. Chem., 30(6)*:613–722, (1991).

Faux, M.C. and Scott, J.D., "More on target with protein phosphorylation: conferring specificity by location", *Trends Biochem., 21*:312–315, (1996).

Felgner et al., "Lipofection: A highly efficient, lipid–mediated DNA–transfection procedure", *Proc. Natl. Acad. Sci. USA, 84*:7413–7417, (1987).

Fu et al., "A DNA sequencing strategy that requires only five bases of known terminal sequences for priming", *Proc. Natl. Acad. Sci. USA, 92*:10162–10166, (1995).

Fu et al., "Efficient preparation of short DNA sequence ladders potentially suitable for MALDI–TOF DNA sequencing", *Genetic Analysis: Biomolecular Engineering, 12*:137–142, (1996).

Fu et al., "Sequencing double–stranded DNA by strand displacement", *Nucl. Acids Res., 25(3)*:677–679, (1997).

Fu et al., "Sequencing Exons 5 to 8 of the p53 Gene by MALDI–TOF Mass Spectrometry", *Nature Biotechnol., 16*:381–384, (1998).

Gabbita et al., "Decreases in Peptide Methionine Sulfoxide Reductase in Alzheimer's Disease Brain", *J. Neurochemistry, 73(4)*:1660–1666, (1999).

Gasparini et al., "Restriction site generating–polymerase chain reaction (RG–PCR) for the probeless detection of hidden genetic variation; application to the study of some common cystic fibrosis mutations", *Mol. Cell. Probes, 6*:1–7, (1992).

Gibbs et al., "Detection of single DNA base differences by competitive oligonucleotide priming", *Nucl. Acids Res., 17*:2437–2448, (1989).

Gillman, A.G., "A Protein Binding Assay for Adenosine 3':5'–cyclic Monophosphate", *Biochem., 67(1)*:305–312, (1970).

Glantz et al., "Characterization of Distinct Tethering and Intracellular Targeting Domains in AKAP75, a Protein That Links cAMP–dependent Protein Kinase IIβ to the Cytoskeleton", *J. Biol. Chem., 268(17)*:12796–12804, (1993).

Goldmacher et al., Photoactivation of toxin conjugates, *Bioconj. Chem.* 3:104–107 (1992).

Goueli et al., "A Novel and Simple Method to Assay the Activity of Individual Protein Kinases in a Crude Tissue Extract", *Analy. Biochem., 225*:10–17, (1995).

Gribskov, M. and Burgess, R.R., "Sigma factors from *E. coli, B. subtilis*, phage SPO1, and T4 are homologous proteins", *Nucl. Acids Res., 14(16)*:6745–6763 (1986).

Griffin, H.G. and Griffin, A.M., "DNA Sequencing. Recent Innovations and Future Trends", *Appl. Biochem. Biotechnol., 38*:147–159, (1993).

Griffin et al., "Genetic analysis by peptide nucleic acid affinity MALDI–TOF mass spectrometry," *Nature Biotechnology, 15*:1368–1372, (1997).

Guatelli et al., "Isothermal, in vitro amplification of nucleic acids by a multienzyme reaction modeled after retroviral replication", *Proc. Natl. Acad. Sci. USA, 87*:1874–1878, (1990).

Guerrier–Takada et al., "The RNA Moiety of Ribonuclease P Is the Catalytic Subunit of the Enzyme", *Cell, 35*:849–857, (1983).

*Guide To Human Genome Computing*, Book: Bishop, M.J. (Ed.), Academic Press, San Diego, California (1994).

Hampel et al., "'Hairpin' catalytic RNA model: evidence for helices and sequence requirement for Substrate RNA", *Nucl. Acid Res., 18(2)*:299–304, (1990).

Hampel, A. and Tritz, R., "RNA Catalytic Properties of the Minimum (–)s TRSV Sequence", *Biochem., 28*:4929–4933, (1989).

*Handbook Of Experimental Immunology In Four Volumes*, Book: vol. 1, "Immunochemistry", Weir, D.M., (and co–Eds), Fourth Edition, Blackwell Scientific Publications, Osney Mead, Oxford, 1986.

Hasan et al., "Base–boronated dinucleotides: synthesis and effect of N7–cyanoborane substitution on the base protons", *Nucl. Acids Res., 24(11)*:2150–2157 (1996).

Hausken et al., "Mutational Analysis of the A–Kinase Anchoring Protein (AKAP)–binding Site on RII", *J. Biol. Chem. 271(46)*:29016–29022, (1996).

Hayashi, K., "PCR–SSCP: A Method for Detection of Mutations", *Genet. Anal. Tech. Appl. (GATA), 9(3)*:73–79, (1992).

Hazum et al., "A Photocleavable Protecting Group For The Thiol Function Of Cysteine", *Pept. Proc. Eur. Pept. Symp., 16th* Brunfeldt, K. (Ed.), pp. 105–110, (1981).

Heaton et al., "Estimation of DNA sequence diversity in bovine cytokine genes", *Mammalian Genome, 12*:32–37, (2001).

Higgins et al., "Competitive Oligonucleotide Single–Base Extension Combined with Mass Spectrometric Detection for Mutation Screening", *BioTechniques, 23(4)*:710–714, (1997).

Higgins et al., "DNA–Joining Enzymes: A Review", *Methods in Enzymology, 68*:50–71, (1979).

Higley, M. and Lloyd, R.S., "Processivity of uracil DNA glycosylase", *Mutation Research, DNA Repair, 294*:109–116, (1993).

Hinton, Jr. et al., "The application of robotics to fluorometric and isotopic analyses of uranium", *Lab. Inf. Manage., 21*:223–227, (1998).

Hu, K. and Siddiqui, A., "Regulation of the Hepatitis B Birus Gene Expression by the Enhancer Element I", *Virology, 181*:721–726, (1991).

Huang, et al., "D–AKAP2, a novel protein kinase A anchoring protein with a putative RGS domain", *Proc. Natl. Acad. Sci. USA, 94*:11184–11189, (1997).

Huang et al., "Identification of a Novel Protein Kinase A Anchoring Protein That Binds Both Type I and Type II Regulatory Subunits", *J. Biol. Chem., 272(12)*:8057–8064, (1997).

Hubbard, M.J. and Cohen, P., "On target with a new mechanism for the regulation of protein phosphorylation", *Trends Biochem. Sci.,* 18:172–177, (1993).

*Immobilised cells and enzymes,* a practical approach, Woodward, J. (Ed.), IRL Press Limited, Oxford, Washington, DC, 1985.

Instrumentation; "Nano–Plotter" from GeSiM, Germany, located at http:/www.gesim.de/np–intro.htm.

Instrumentation; "Model CRS A 255" robot "Digital Servo Gripper" "Plate Cube" system. "lid parking station" "shaker" Robocon Labor–und Industrieroboter Ges.m.b.H of Austria ("Robocon").

Instrumentation; "MJ Microseal" plate sealer; Thermal Cycler Accessories: Sealing Options, Sealing Products, MJ Research, located at http://www.mjresearch.com/html/consumables/ealing/sealing_products.html.

Instrumentation; "Genesis 200/8" (200 cm with including an 8–tip arm) liquid handling sytems; Tecan AG of Switzerland ("Tecan"), TECAN Products for Diagnostics and Life Science, located at http://www.tecan.ch/index.htm.

Instrumentation; Bar code systems, including one and two dimensional bar codes, readable and readable/writable codes and systems; Datalogic S.p.A. of Italy ("Datalogic") located at http://www.datalogic.com.

Instruemntation; DYNABEADS, streptavidin–coated magnetic beads; from Dynal, Inc. Great Neck, NY and Oslo Norway.

Instrumentation; "Multimek 96" automated pipettor; Beckman Coulter, Inc. located at http://www.coulter.com, Sep. 8, 1999.

International Search Report for International Application No. PCT/USOO/08111, Date of Mailing Nov. 13, 2000.

IUPAC–IUB Commission on Biochemical Nomenclature A One–Letter Notation for Amino Acid Sequences[1–3] Tentative Rules, *J. Biol. Chem.,* 243(*13*):3557–3559, (1968).

Jahnsen et al., "Molecular Cloning, cDNA Structure, and Regulation of the Regulatory Subunit of Type II cAMP–dependent Protein Kinase from Rat Ovarian Granulose Cells", *J. Biol. Chem.,* 261(*26*):12352–12361, (1986).

Janin, J., "Surface and inside volumes in globular proteins", *Nature,* 277:491–492, (1979).

Jiang–Baucom et al., "DNA Typing of Human Leukocyte Antigen Sequence Polymorphisms Nucleic Acid Probes and MALDI–TOF Mass Spectrometry," *Analytical Chemistry,* 69:4894–4898, (1997).

Jurinke et al., "Analysis of Ligase Chain Reaction products via Matrix–Assisted Laser Desorption/Ionization Time–of–Flight–Mass Spectrometry", *Anal. Biochem.,* 237:174–181, (1996).

Jurinke et al., "Application of nested PCR and mass spectrometry for DNA–based virus detection: HBV–DNA detected in the majority of isolated anti–HBc positive sera", *Genetic Analysis: Biomolecular Engineering,* 14:97–102, (1998).

Jurinke et al., "Detection of hepatitis B virus DNA in serum samples via nested PCR and MALDI–TOF mass spectrometry," *Genetic Analysis: Biomolecular Engineering,* 13:67–71, (1996).

Jurinke et al., "Detection of RET proto–oncogene codon 634 mutations using mass spectrometry", *J. Mol. Med.,* 75:745–750, (1997).

Jurinke et al., "Recovery of Nucleic Acids from Immobilized Biotin–Streptavidin Complexes Using Ammonium Hydroxide and Applications in MALDI–TOF Mass Spectrometry", *Anal. Chem.,* 69:904–910, (1997).

Kario et al., "Genetic Determinants of Plasma Factor VII Activity in the Japanese", *Thromb. Haemost.,* 73:617–622, (1995).

Keen et al., "Rapid detection of single base mismatches as heteroduplexes on Hydrolink gels", *Trends Genet.,* 7:5, (1991).

Keown, et al., "Methods for Introducing DNA into Mammalian Cells", *Methods in Enzymol.,* 185:527–537, (1990).

Klauck et al., "Coordination of Three Signaling Enzymes by AKAP79, a Mammalian Scaffold Protein", *Science,* 271:1589–1592, (1996).

Kornher, J.S. and Livak, K.J., "Mutation detection using nucleotide analogs that alter electrophoretic mobility", *Nucl. Acids Res.,* 17:7779–7784, (1989).

Köster et al., "Oligonucleotide synthesis and multiples DNA sequencing using chemiluminescent detection", *Nucl. Acids Res.,* Symposium Series No. 24, pp. 318–321, (1991).

Köster et al., "A strategy for rapid and efficient DNA sequencing by mass spectrometry", *Nature Biotechnology,* 14:1123–1128, (1996).

Kozal et al., "Extensive polymorphisms observed in HIV–1 clade B protease gene using high–density oligonucleotide arrays", *Nature,* 2(*7*):753–759 (1996).

Kuppuswamy et al., "Single nucleotide primer extension to detect genetic diseases: Experimental application to hemophilia B (factor IX) and cystic fibrosis genes", *Proc. Natl. Acad. Sci. USA,* 88:1143–1147, (1991).

Kwoh et al., "Transcription–based amplification system and detection of amplified human immunodeficiency virus type 1 with a bead–based sandwich hybridization format", *Proc. Natl. Acad. Sci. USA,* 86:1173–1177, (1989).

Kyte, J. and Doolittle, R.F., "A Simple Method for Displaying the Hydropathic Character of a Protein", *J. Mol. Biol.,* 157:105–132, (1982).

Lacy et al., "A Foreign α–Globin Gene in Transgenic Mice: Integration at Abnormal Chromosomal Positions and Expression in Inappropriate Tissues", *Cell,* 34:343–358, (1983).

Laken et al., "Familial colorectal cancer in Ashkenazim due to a hypermutable tract in APC", *Nature Genetics,* 17:79–83, (1995).

Lam et al., "Genetic influence of the R/Q353 genotype on factor VII activity is overwhelmed by environmental factors in Chinese patients with Type II (non–insulin–dependent) dianetes mellitus", *Diabetologia,* 41:760–766, (1998).

Landegren et al., "A Ligase–Mediated Gene Detection Technique", *Science,* 241:1077–1080, (1988).

Lasko et al., "Eukaryotic DNA Ligases", *Mutation Research,* 236:277–287, (1990).

Lee et al., "Isolation of a cDNA clone for the type I regulatory subunit of bovine cAMP–dependent protein kinase", *Proc. Natl. Acad. Sci. USA,* 80:3608–3612, (1983).

Lehman, I.R., "DNA Ligase: Structure, Mechanism, and Function", *Science,* 186:790–797, (1974).

Li et al., "Boron–containing oligodeoxyribonucleotide 14mer duplexes: enzymatic synthesis and melting studies", *Nucl. Acids Res.,* 23(*21*):4495–4501, (1995).

Li et al., "DNA ligase 1 is associated with the 21 S complex of enzymes for DNA synthesis in HeLa cells", *Nucl. Acids Res.,* 22(*4*):632–638, (1994).

Li et al., "High–Resolution MALDI Fourier Transform Mass Spectrometry of Oligonucleotides", *Anal. Chem., 68(13)*:2090–2096, (1996).

Lindahl, T. and Barnes, D.E., "Mammalain DNA Ligases", *Annu. Rev. Biochem., 61*:251–281, (1992).

Little et al., "Detection of RET proto–oncogene codon 634 mutations using mass spectrometry," *J. Mol. Med., 75*:745–750, (1997).

Little et al., "Direct detection of synthetic and biologically generated double–stranded DNA by MALDI–TOF MS," *International Journal of Mass Spectrometry and IOn Processes, 169–170*:323–330, (1997).

Little et al., "Identification of Apolipoprotein E Polymorphisms Using Temperature Cycled Primer Oligo Base Extension and Mass Spectrometry", *Eur. J. Clin. Chem. Clin. Biochem., 35(7)*:545–548, (1997).

Little et al., MALDI on a Chip: Analysis of Arrays of Low–Femtomole to Subfemtomole Quantities of Synthetic Oligonucleotides and DNA Diagnostic Products Dispensed by a Piezoelectric Pipet, *Anal. Chem., 69*:4540–4546, (1997).

Little et al., "Mass spectrometry from miniaturized arrays for full comparative DNA analysis," *Nature Medicine, 3(12)*:1413–1416, (1997).

Lizardi et al., "Exponential Amplification of Recombinant–RNA Hybridization Probes", *Bio/Technology, 6*:1197–1202, (1988).

*Manipulating the Mouse Embryo*, Book: A Laboratory Manual, Hogan et al., Cold Spring Harbor Laboratory (1986).

Maxam, A.M. and Glibert, W., "A new method for sequencing DNA", *Proc. Natl. Acad. Sci. UsA, 74(2)*:560–564, (1977).

McKnight et al., "Expression of the Chicken Transferrin Gene in Transgenic Mice",*Cell, 34*:335–341, (1983).

*Methods in Enzymology*,"Guide to Protein Purification", Book: vol. 182, Deutscher, M.P. (Ed.), Academic Press, Inc., New York (1990).

*Methods in Enzymology*, "Recombinant DNA", Book: vol. 154, Part E, Wu, R. and Grossman, L. (Eds.), Academic Press, Inc., New York (1987).

*Methods in Enzymology*, "Recombinant DNA", Book: vol. 155, Part F, Wu, R. (ed.), Academic Press, Inc., New York (1987).

*Methods in Molecular Biology. 24*, "Computer Analysis of Sequence Data", Book: Part I, Griffin, A.M. and Griffin, H.G. (Eds.), Humana Press, Totowa, New Jersey (1994).

Miki, K. and Eddy, E.M., "Identification of Tethering Domains for Protein Kinase A Type Iα Regulatory Subunits on Sperm Fibrous Sheath Protein FSC1", *J. Biol. Chem., 273(51)*: 34384–34390, (1996).

Miki, K. and Eddy, E.M., "Single Amino Acids Determine Specificity of Binding Protein Kinase A Regulatory Subunits by Protein Kinase A Anchoring Proteins", *J. Biol. Chem., 274(41)*:29057–29062, (1999).

Mochly–Rosen, D., "Localization of Protein Kinases by Anchoring Proteins: A Theme in Signal Transduction", *Science, 268*:247–251, (1995).

*Molecular Biology Of The Gene*, Book: "General Principles", vol. 1, Fourth Edition, Watson et al., The Benjamin/Cummings Publishing Company, Inc., 1987.

*Molecular Cloning*, a Laboratory Manual, Book: Second Edition, Sambrook, J. and Russell, D.W., Cold Spring Harbor Laboratory Press (1989).

Monforte et al., "High–throughput DNA analysis by time–of–flight mass spectrometry," *Nature Medicine, 3(3)*:36–42, (1997).

Moskovitz et al., "Overexpression of peptide–methionine sulfoxide reductase in *Saccharomyces cerevisiae* and human T cells provides them with high resistance to oxidative stress", *Proc. Natl. Acad. Sci. USA, 95*:14071–14075, (1998).

Myers et al., "Detection of Single Base Substitutions by Ribonuclease Cleavage at Mismatches in RNA:DNA Duplexes", *Science, 230*:1242–1246, (1985).

Myers et al., "Detection of single base substitutions in total genomic DNA", *Nature, 313*:495–498, (1985).

Nakamaye et al., "Direct sequencing of polymerase chain reaction amplified DNA fragments through the incorporation of deoxynucleoside α–thiotriphosphates", *Nucl. Acids Res., 16*:9947–9959, (1888).

Naeve et al., "Accuracy of Automated DNA Sequencing: A Multi–Laboratory Comparison of Sequencing Results", *Biotechniques, 19(3)*:448–453, (1995).

Newton et al., "Analysis of any point mutation in DNA. The amplification refractory mutation system (ARMS)", *Nucl. Acids Res., 17*:2503–2516, (1989).

Ngai et al., "Protein A antibody–capture ELISA (PACE): an ELISA format to avoid denaturation of surface–adsorbed antigens", *J. Immunol. Meth., 158*:267–276, (1993).

Nickerson et al., "Automated DNA diagnostics using an ELISA–based oligonucleotide ligation assay", *Proc. Natl. Acad. Sci. USA, 87*:8923–8927, (1990).

Nilges et al., "Automated NOESY interpretation with ambiguous distance restraints: the refined NMR solution structure of the pleckstrin homology domain from β–spectrin", *J. Mol. Biol., 269*:408–422, (1997).

Nordhoff et al., "Matrix–assisted Laser Desorption/Ionization Mass Spectrometry of Nucleic Acids with Wavelengths in the Ultraviolet and Infrared", *Rapid Comm. Mass Spectrom., 6*:771–776, (1992).

*Nucleases*, Book: 2nd Edition, Linn, S.M. et al. (Eds.), Cold Spring Harbor Laboratory Press (1993).

*Nucleic acid hybridisation*, a practical approach, Book: Hames, B.D. and Higgins, S.J. (Eds.), IRL Press, Oxford, Washington DC (1985).

Nyrén et al., "Solid phase DNA minisequencing by an enzymatic luminometric inorganic pyrophosphate detection assay", *Anal. Biochem., 208*:171–175, (1993).

*Oligonucleotides and Analogues*, a practical approach, Book: Protocol 8. "Synthesis of 3'5'–O–(tetraisopropyldisiloxane–1,3–diyl)–$N^4$–isobutyryl–2'–O–methylcytidine (compound 8); mol. wt 569.85", Eckstein, F. (Ed.), Oxford University Press, New York, pp. 56–57; Chapter 6, "Synthesis of oligo–2'–deoxyribonucleoside methylphosphonates", pp. 137–139; and pp. 256–259, (1991).

*Oligonucleotides synthesis*, a practical approach, Book: Gait, M.J. (Ed.), IRL Press, Oxford, Washington DC (1984).

Orita et al., "Detection of polymorphisms of human DNA by gel electrophoresis as single–strand conformation polymorphisms", *Proc. Natl. Acad Sci. USA, 86*:2766–2770, (1989).

Palmiter et al., "Differential Regulation of Metallothionein–Thymidine Kinase Fusion Genes in Transgenic Mice and Their Offspring", *Cell, 29*:701–710, (1982).

Palmiter et al., "Dramatic growth of mice that develop from eggs microinjected with metallothionein–growth hormone fusion genes", *Nature, 300*:611–615, (1980).

Palmiter et al., "Matallothionein–human GH fusion genes stimulates growth of mice", Science, 222:809–814, (1983).

Pearson, W.R. and Lipman, D.J., "Improved toos for biological sequence comparison", Proc. Natl. Acad. Sci. USA, 85:2444–2448,(1988).

Pearson, R.B. and Kemp, B.E., "Protein Kinase Phosphorylation Site Sequences and Consensus Specificity Motifs: Tabulations", Meth. Enzymol., 200:62–81, (1991).

Perrotta, A.T. and Been, M.D., "Cleavage of Oligoribonucleotides by a Ribozyme Derived from the Hepatitis δ Virus RNA Sequence", Biochem., 31:16–21, (1992).

Podhajska, A.J. and Szybalski, W., "Conversion of the FokI endonuclease to a universal restriction enzyme: cleavage of phage M13mp7 DNA at predetermined sites", Gene, 40:175–182, (1985).

Porter et al., "$N^1$–Cyanoborane_2'–Triphosphate is a Good Substrate for DNA Polymerase", Biochem., 34:11963–11969, (1995).

Prezant, T.R. and Fischel–Ghodsian, N., "Trapped–Oligonucleotide Nucleotide Incorporation (TONI) Assay, a Simple Method for Screening Point Mutations", Human Mutation, 1:159–164, (1992).

Prosser, J., "Detecting single–base mutations", TIBTECH, 11:238–246, (1993).

Pruslin et al., "Caveats and suggestions for the ELISA", J. Immunol. Meth., 137:27–35, (1991).

Reymer et al., "A lipoprotein lipase mutation (Asn291Ser) is associated with reduced HDL cholesterol levels in premature atherosclerosis", Nature Genetics, 10:28–34, (1995).

Rose et al., "Hydrophobicity of Amino Acid Residues in Globular Proteins", Science, 229:834–838, (1985).

Rosenbaum, V. and Riesner, D., "Temperature–gradient gel electrophoresis. Thermodynamic analysis of nucleic acids and proteins in purified form and in cellular extracts", Biophy. Chem., 26:236–246, (1987).

Ross et al., "Analysis of Short Tandem Repeat Polymorphisms in Human DNA by Matrix–Assisted Laser Desorption/IOnization Mass Spectrometry," Analytical Chemistry, 69:3966–3972, (1997).

Ross et al., "Discrimination of Single–Nucleotide Polymorphisms in Human DNA Using Peptide Nucleic Acid Probes Detected by MALDI–TOF Mass Spectrometry," Analytical Chemistry, 59:4197–4202, (1997).

Rossi et al., "Ribozymes as Anti–HIV–1 Therapeutic Agents: Principles, Applications, and Problems", Aids Res. and Human Retroviruses, 8(2):183–189, (1992).

Ruppert et al., "A Filtration Method for Plasmid Isolation Using Microtiter Filter Plates", Anal. Biochem., 230:130–134, (1995).

Saiki et al., "Analysis of enzymatically amplified β–globin and HLA–DOα DNA with allele–specific oligonucleotide probes", Nature, 324:163–166, (1986).

Saiki et al., "Genetic analysis of amplified DNA with immobilized sequence–specific oligonucleotide probes", Proc. Natl. Acad. Sci. USA, 86:6230–6234, (1989).

Saleeba, J.A. and Cotton, R.G.H., "Chemical Cleavage of Mismatch to Detect Mutations", Meth. Enzymol., 217:286–295, (1993).

Samson et al., "Resistance to HIV–1 infection in caucasian individuals bearing mutant alleles of the CCR–5 chemokine receptor gene", Nature, 382:722–725, (1996).

Sanger et al., "DNA sequencing with chain–terminating Inhibitors", Proc. Natl. Acad. Sci. USA, 74(12):5463–5467, (1977).

Sanghvi, Y.S., Book: Antisense Research and Applications, Chapter 15, "Heterocyclic Base Modifications In Nucleic Acids and Their Applications In Antisense Oligonucleotides", S.T. Crooke et al. (Eds.), CRC Press, Inc., Florida, 1993.

Saparbaev et al., "Escherichia coli, Saccharomyces cerevisiae, rat and human 3–methyladenine DNA glycosylases repair 1, $N^6$ethenoadenine when present in DNA", Nucl. Acids Res., 23(18):3750–3755, (1995).

Sarin et al., "Inhibition of acquired immunodeficiency syndrome virus by oligodeoxy–nucleoside methylphosphonates", Proc. Natl. Acad. Sci. USA, 85:7448–7451, (1988).

Schächter et al., "Genetic associations with human longevity at the APOE and ACE loci", Nature Genetics, 6:29–32, (1994).

Schwartz, R.M. and Dayhoff, M.O., "Matrices for Detecting Distant Relationships", Atlas of Protein Sequence and Structure, pp. 353–358, (1978).

Scopes, R.K., Book: Protein Purification, Principles and Practice, Springer–Verlag, New York, (1982).

Scott, J., "Cyclic Nucleotide–Dependent Protein Kinases", Pharmac. Ther., 50:123–145, (1991).

Scott et al., "Type II Regulatory Subunit Dimerization Determines the Subcellular Localization of the cAMP–dependent Protein Kinase", J. Biol. Chem., 265(35):21561–21566, (1990).

Senko et al., "Automated Assignment of Charge States from Resolved Isotopic Peaks for Multiply Charged Ions", J. Am. Soc. Mass Spectrom, 6:52–56, (1995).

Senter et al., "Novel photocleavable protein crosslinking reagents and their use in the preparation of antibody–toxin conjugates", Photochem. Photobiol., 42:231–237, (1985).

Sequence Analysis in Molecular Biology, Book: Treasure Trove or Trivial Pursuit, von Heijne, G., Academic Press, Inc., New York, 1987.

Sequence Analysis Primer, Book: Gribskov M. and Devereux, J. (Eds.), W.H. Freeman and Company, New York, 1992.

Sequenom Advances the Industrial Genomics Revolution with the Launch of Its DNA MassArray™Automated Process Line, Press Release: Sept. 28, 1998, http://www.sequenom.com/pressrelease.htm.

Sequenom Completes Design of More Than 400,000 SNP Assays; Mass EXTENDTM Assay Portfolio Covers Majority of SNPs in the Public Domain, Press Release; Oct. 10, 2000, http://www/sequenom.com/ir/ir_prs.asp.

Sequenom and Gemini Identify Genes Linked to Cardiovascular Disease, Press Release: Nov. 28, 2000, http://www/sequenom.com/ir/ir_prs.asp.

Sequenom Anounces Publication of Results From Large–Scale SNP Study With the National Cancer Institute, Press Release: Jan. 16, 2001, http://www/sequenom.com/ir/ir_prs.asp.

Sequenom: Technologies and Tools, located at http://www.sequenom–san.com/tech/tools.html, dated Aug. 29, 1999.

Siegert et al., "Matrix–Assisted Laser desorption/Ionization Time–of–Flight Mass Spectrometry for the detection of Polymerase Chain Reaction Containing 7–Deazapurine Moieties", Anal. Biochem., 243:55–65, (1996).

Smith, D.B. and Johnson, K.S., "Single–step purification of polypeptides expressed in Escherichia coli as fusions with glutathione S–transferase", Gene, 67:31–40, (1988).

Smith, T.F. and Waterman, M.S., "Comparison of Biosequences", *Advances in Applied Mathemetics*, 2:482–489, (1981).

Smith, L.M., "Sequence from spectrometry: A realistic prospect", *Nature Biotechnology*, 14:1084–1085, (1996).

Sokolov, B.P., "Primer extension technique for the detection of single nucleotide in genomic DNA", *Nucl. Acids Res.*, 18(12):3671, (1989).

Srinivasan et al., "Matrix–assisted Laser Desorption/Ionization Time–of–flight Mass Spectrometry as a Rapid Screening Method to Detect Mutations Causing Tay–Sachs Disease," *Rapid Communications in Mass Spectrometry*, 11:1144–1150, (1997).

Stein et al., "Physicochemical properties of phosphorothioate oligodeoxynucleotides", *Nucl. Acids Res.*, 16:3209–3221, (1988).

Steward et al., "Human β–Globin Gene Sequence Injected into Mouse Eggs, Retained in Adults, and Transmitted to Progeny", *Science*, 217:1046–1048, (1982).

Stillman, B.W. and Gluzman, Y., "Replication and Supercoiling of Simian Virus 40 DNA in Cell Extracts from Human Cells", *Mol. Cell. Biol.*, 5(8):2051–2060, (1985).

Sugisaki, H. and Kanazawa, S., "New restriction endonucleases from *Flavobacterium okeanokoites* (Fokl) and *Micrococcus luteus* (Miul)", *Gene*, 16:73–78, (1981).

Syvänen et al., "A Primer–Guided Nucleotide Incorporation Assay in the Genotyping of Apoliproprotein E", *Genomics*, 8:684–692, (1990).

Syvänen et al., "Identification of Individuals by analysis of Biallelic DNA markers, using PCR and Solid–Phase Minisequencing", *Am. J. Hum. Genet.*, 52:46–59, (1993).

Szybalski et al., "Class–IIS restriction enzymes—a review", *Gene*, 100:13–26, (1991).

Takio et al., "Primary structure of the regulatory subunit if type II cAMP dependent protein kinase from bovine cardiac muscle", *Proc. Natl. Acad. Sci. USA*, 79:2544–2548, (1982).

Tammen et al., "Preteolytic cleavage of glucagon–like peptide–1 by pancreatic β cells and by fetal calf serum analyzed by mass spectrometry", *J. Cromatogr. A*, 852:285–295, (1999).

Tang et al., "Chip–based genotyping by mass spectrometry", *Proc. Natl. Acad. Sci. USA*, 96:10016–10020, (1999).

Tang et al., "Matrix–assisted laser desorption/ionization mass spectrometry of immobilized duplex DNA probes", *Nucl. Acids Res.*, 23(16):3126–3131, (1996).

Taranenko et al., "Laser desorption mass spectrometry for point mutation detection" *Genetic Analysis: Biomolecular Engineering*, 13:87–94, (1996).

Thompson, J.N., "Fitting robots with white coats", *Laboratory Automation and Information Management*, 31:173–193, (1996).

Tobe et al., "Single–well genotyping of diallelic sequence variations by a two–color ELISA–based oligonucleotide ligation assay", *Nucl. Acids Res.*, 24:3728–3732, (1996).

*Transscription and translation*, a practical approach, Book: Harnes, B.D. and Higgins, S.J. (Eds.), IRL Press Limited, Oxford, England (1984).

Udenfriend et al., "Scintillation Proximity Assay: A Sensitive and Continuous Isotopic Method for Monitoriong Ligand/Receptor and Antigen/Antibody Interactions", *Anal. Biochem.*, 161:494–500, (1987).

Undenfriend et al., "Scintillation proximity radioimmunoassay utilizing $^{125}$I–labeled ligands", *Proc. Natl. Acad. Sci. USA*, 82:8672–8676, (1985).

Ugozzoli, et al., "Detection of Specific Alleles by Using Allele–Specific Primer Extension Followed by Capture on Solid Support", *Genet. Anal. Tech. Appl.(GATA)*, 9(4):107–112, (1992).

Uracil–DNA Glycosylase, product description. Roche Molecular Biochemicals Catalog Version 3, Nov. 1999 http:/biochem.roche.com/pack–insert/1269062a.pdf, (Dec. 21, 2000).

Uracil–DNA Glycosylase (UDG), products description, New England Biolabs. http://circuit.neb.com/neb/products/mod_enzymes/280.html, (Dec. 21, 2000).

Urlaub, G. and Chasin, L.A., "Isolation of Chinese hamster cell mutants deficient in dihydrofolate reductase activity", *Proc. Natl. Acad. Sci. USA*, 77(7):4216–4220, (1980).

van den Boom et al., "Forward and Reverse DNA Sequencing in a Single Reaction", *Anal. Biochem.*, 256:127–129, (1998).

van den Boom et al., "Combined amplification and sequencing in a single reaction using two DNA polymerase with differential incorporation rates for dideoxynucleotides", *J. Biochem. Biophys. Methods*, 35:69–79, (1997).

Vaughan et al., "Glycosylase mediated polymorphism detection (GPMPD)—anovel process for genetic analysis", *Genetic Analysis: Biomolecular Engineering*, 14:169–175, (1999).

Wada et al., "Detection of Single–nucleotide Mutations Including Substitutions and Deletions by Matrix–assisted Laser Desorption/Ionization Time–of–flight Mass Spectrometry," *Rapid Communications in Mass Spectrometry*, 11:1657–1660, (1997).

Waga et al., "Reconstitution of Complete SV40 DNA Replication with Purified Replication Factors", *J. Biol. Chem.*, 269(14):10923–10934, (1994).

Wagner et al., "The human β–globin gene and a functional viral thymidine kinase gene in developing mice", *Proc. Natl. Acad. Sci. USA*, 78:5016–5020, (1981).

Wallace et al., "Hybridization of synthetic oligodeoxyribonucleotides to phi chi 174 DNA: the effect of single base pair mismatch", *Nucl. Acids Res.*, 6:3543–3557, (1979).

Wang et al., "Allene $\gamma_9$ and $\gamma_{10}$: low–temperature measurements of line intensity", *J. Mol. Spectrosc.*, 194(20):256–268, (1999).

Weiler et al., "Hybridisation based DNA screening on peptide nucleic acid (PNA) oligomer arrays", *Nucl. Acids Res.*, 25:2792–2799, (1997).

Wigler et al., "DNA–mediated transfer of the adenine phosphoribosyltransferase locus into mammalian cells", *Proc. Natl. Acad. Sci. USA*, 76(3):1373–1376, (1979).

Wilson, G.G. and Murray, N.E., "Restriction and Modification Systems", *Annu. Rev. Genet.*, 25:585–627, (1991).

Wolfenden et al., "Affinities of Amino Acid Side Chains for Solvent Water", *Biochem.*, 20:849–855, (1981).

Yan et al., Optically controlled ligand delivery, 1, "Synthesis of water–soluble copolymers containing photocleavable bonds", *Makromol. Chem.*, 190:69–82, (1989).

Genbank Accession AF037439.

Genbank Accession NM007202.
Genbank Accession AF021833.
Genbank Accession AC005730.
Genbank Accession AW195104.
Genbank Accession AW874187.
Genbank Accession AF096289.
Genbank Accession X86173.
Genbank Accession AJ242973.

Laken et al., "Genotyping by mass spectrometric analysis of short DNA fragments", *Nature Biotechnology*, *16*:1352–1356 (1998).

Shriver et al., "Ethnic–Affiliation Estimation by Use of Population–Specific DNA Markers", *Am. J. Hum. Genet.*, *60*:957–964 (1997).

\* cited by examiner

POLYMORPHIC KINASE ANCHOR PROTEINS AND NUCLEIC ACIDS ENCODING THE SAME

RELATED APPLICATIONS

Benefit of priority under 35 U.S.C. §119(e) to U.S. provisional application Ser. No. 60/217,251, filed Jul. 10, 2000, to Andreas Braun, entitled "POLYMORPHIC KINASE ANCHOR PROTEINS AND NUCLEIC ACIDS ENCODING THE SAME" is claimed herein. Benefit of priority under 35 U.S.C. §119(e) to U.S. provisional application Ser. No. 60/240,335, filed Oct. 13, 2000, to Andreas Braun, entitled "POLYMORPHIC KINASE ANCHOR PROTEINS AND NUCLEIC ACIDS ENCODING THE SAME" also is claimed herein.

This application is related to U.S. application Ser. No. 09/687,483 and International PCT Application No. PCT/US00/28413, each to Andreas Braun, Hubert Köster and Dirk van den Boom, each entitled "METHODS FOR GENERATING DATABASES AND DATABASES FOR IDENTIFYING POLYMORPHIC GENETIC MARKERS", and each filed Oct. 13, 2000. This application is also related to U.S. Provisional Application Ser. No. 60/159,176 to Andreas Braun, Hubert Köster; Dirk Van den Boom, filed Oct. 13, 1999, entitled "METHODS FOR GENERATING DATABASES AND DATABASES FOR IDENTIFYING POLYMORPHIC GENETIC MARKERS". This application is also related to U.S. Provisional Application Ser. No. 60/217,658 to Andreas Braun, Hubert Köster; Dirk Van den Boom, filed Jul. 10, 2000, entitled "METHODS FOR GENERATING DATABASES AND DATABASES FOR IDENTIFYING POLYMORPHIC GENETIC MARKERS".

The subject matter of each of above-noted U.S. provisional applications, U.S. applications and PCT application is incorporated herein in its entirety.

FIELD OF THE INVENTION

Polymorphic A-kinase anchor proteins (AKAPs) and nucleic acids encoding the proteins are provided herein. Methods of detecting polymorphic AKAPs and nucleic acids encoding the AKAPs, and kits for use in the detection methods are also provided. Further provided herein are methods of identifying subjects having or at a risk of developing disorders of cellular protein phosphorylation and/or signal transduction. Methods of determining susceptibility to morbidity and/or increased or early mortality are also provided.

BACKGROUND OF THE INVENTION

Protein phosphorylation is an important mechanism for enzyme regulation and the transduction of extracellular signals across the cell membrane in eukaryotic cells. A wide variety of cellular substrates, including enzymes, membrane receptors, ion channels and transcription factors, can be phosphorylated in response to extracellular signals that interact with cells. A key enzyme in the phosphorylation of cellular proteins in response to hormones and neurotransmitters is cyclic AMP (cAMP)-dependent protein kinase (PKA). Upon activation by cAMP, PKA thus mediates a variety of cellular responses to such extracellular signals.

An array of PKA isozymes are expressed in mammalian cells. The PKAs usually exist as inactive tetrameres containing a regulatory (R) subunit dimer and two catalytic (C) subunits. Genes encoding three C subunits (Cα, Cβ and Cγ) and four R subunits (RIα, RIβ, RIIα and RIIβ) have been identified (see Takio et al. (1982) *Proc. Natl. Acad. Sci. U.S.A.* 79:2544–2548; Lee et al. (1983) *Proc. Natl. Acad. Sci. U.S.A.* 80:3608–3612; Jahnsen et al. (1996) *J. Biol. Chem.* 261:12352–12361; Clegg et al. (1988) *Proc. Natl. Acad. Sci. U.S.A.* 85:3703–3707; and Scott (1991) *Pharmacol. Ther.* 50:123–145). The type I (RI) α and type II (RII) α subunits are distributed ubiquitously, whereas RIβ and RIIβ are present mainly in brain (see. e.g., Miki and Eddy (1999) *J. Biol. Chem.* 274:29057–29062). The type I PKA holoenzyme (RIα and RIβ) is predominantly cytoplasmic, whereas the majority of type II PKA (RIIα and RIIβ) associates with cellular structures and organelles (Scott (1991) *Pharmacol. Ther.* 50:123–145). Many hormones and other signals act through receptors to generate cAMP which binds to the R subunits of PKA and releases and activates the C subunits to phosphorylate proteins.

Because protein kinases and their substrates are widely distributed throughout cells, there are mechanisms in place in cells to localize protein kinase-mediated responses to different signals. One such mechanism involves subcellular targeting of PKAs through association with anchoring proteins, referred to as A-kinase anchoring proteins (AKAPs), that place PKAs in close proximity to specific organelles or cytoskeletal components and particular substrates thereby providing for more specific PKA interactions and localized responses (see, e.g., Scott et al. (1990) *J. Biol. Chem.* 265:21561–21566; Bregman et al. (1991) *J. Biol. Chem.* 266:7207–7213; and Miki and Eddy (1999) *J. Biol. Chem.* 274:29057–29062). Anchoring not only places the kinase close to preferred substrates, but also positions the PKA holoenzyme at sites where it can optimally respond to fluctuations in the second messenger cAMP (Mochly-Rosen (1995) *Science* 268:247–251; Faux and Scott (1996) *Trends Biochem. Sci.* 21:312–315; Hubbard and Cohen (1993) *Trends Biochem. Sci.* 18:172–177).

Up to 75% of type II PKA is localized to various intracellular sites through association of the regulatory subunit (RII) with AKAPs (see, e.g., Hausken et al. (1996) *J. Biol. Chem.* 271:29016–29022). RII subunits of PKA bind to AKAPs with nanomolar affinity (Carr et al. (1992) *J. Biol. Chem.* 267:13376–13382), and many AKAP-RII complexes have been isolated from cell extracts. RI subunits of PKA bind to AKAPs with only micromolar affinity (Burton et al. (1997) *Proc. Natl. Acad. Sci. U.S.A.* 94:11067–11072). Evidence of binding of a PKA RI subunit to an AKAP has been reported (Miki and Eddy (1998) *J. Biol. Chem* 273:34384–34390) in which RIα-specific and RIα/RIIα dual specificity PKA anchoring domains were identified on FSC1/AKAP82. Additional dual specific AKAPs, referred to as D-AKAP1 and D-AKAP2, which interact with the type I and type II regulatory subunits of PKA have also been reported (Huang et al. (1997) *J. Biol. Chem.* 272:8057–8064; Huang et al. (1997) *Proc. Natl. Acad. Sci. U.S.A.* 94:11184–11189).

More than 20 AKAPs have been reported in different tissues and species. Complementary DNAs (cDNAs) encoding AKAPs have been isolated from diverse species, ranging from *Caenorhabditis elegans* and *Drosophilia* to human (see, e.g., Colledge and Scott (1999) *Trends Cell Biol.* 9:216–221). Regions within AKAPs that mediate association with RII subunits of PKA have been identified. These regions of approximately 10–18 amino acid residues vary substantially in primary sequence, but secondary structure predictions indicate that they are likely to form an amphipathic helix with hydrophobic residues aligned along one face of the helix and charged residues along the other (Carr et al. (1991) *J. Biol. Chem.* 266:14188–14192; Carr et al.

(1992) *J. Biol. Chem.* 267:13376–13382). Hydrophobic amino acids with a long aliphatic side chain, e.g., valine, leucine or isoleucine, may participate in binding to RII subunits (Glantz et al. (1993) *J. Biol. Chem.* 268:12796–12804).

Many AKAPs also have the ability to bind to multiple proteins, including other signalling enzymes. For example, AKAP79 binds to PKA, protein kinase C (PKC) and the protein phosphatase calcineurin (PP2B) (Coghlan et al. (1995) *Science* 267:108–112 and Klauck et al. (1996) *Science* 271:1589–1592). Therefore, the targeting of AKAP79 to neuronal postsynaptic membranes brings together enzymes with opposite catalytic activities in a single complex.

AKAPs thus serve as potential regulatory mechanisms that increase the selectivity and intensity of a cAMP-mediated response. There is a need, therefore, to identify and elucidate the structural and functional properties of AKAPs in order to gain a complete understanding of the important role these proteins play in the basic functioning of cells.

SUMMARY OF THE INVENTION

Previously unidentified alleles of the human AKAP10 gene are provided. One allele, designated AKAP10-5 contains a previously undisclosed single nucleotide polymorphism (SNP), an A-to-G transition, at nucleotide position 2073 of the AKAP10 gene coding sequence. This SNP is located in the C-terminal PKA binding domain, and results in an Ile-to-Val substitution at the protein level for the AKAP10 gene protein product. Another allele, designated AKAP10-6 contains a previously undisclosed single nucleotide polymorphism (SNP), a C-to-G transversion, at nucleotide position 83587 of the human chromosome 17 sequence (SEQ ID NO: 17). The AKAP10 gene is located at approximately nucleotide position 83,580 to nucleotide position 156,577 of the chromosome 17 sequence. This SNP is located in the 5' untranslated region and 132 nucleotides upstream of the translation start site. A further allele, designated AKAP10-7 contains a previously undisclosed single nucleotide polymorphism (SNP), a G-to-A transition, at nucleotide position 129,600 of the human chromosome 17 sequence. This SNP is located four bases 3' to the exon 10/intron 10 boundary of AKAP10 mRNA.

Utilizing a healthy patient database, the frequency of occurrence of two allelic variants of the AKAP10 gene, AKAP10-5 and AKAP10-1, in such a population were found to decrease with age. AKAP10-1 is an allelic variant with a T to C transversion at nucleotide position 156,277 of the AKAP10 genomic clone which is located in the 3' untranslated region of the gene. The AKAP10-5 and AKAP10-1 alleles are useful markers for predicting susceptibility to morbidity and/or increased or early mortality. Methods are provided for predicting susceptibility to morbidity, increased or early mortality, or morbidity and increased mortality, by detecting the presence of the AKAP10 allelic variants, individually, or in combination with other AKAP10 allelic variants, in an organism, particularly an animal and particularly a human. Methods are also provided for indicating or predicting an alteration in signal transduction in an organism. Furthermore, AKAP10-5 and other allelic variants of the AKAP10 gene are potential functional variants of a morbidity susceptibility gene and/or of a gene involved in increased mortality and/or a gene related to an alteration in signal transduction and associated disorders and thus may also be useful for screening for potential therapeutics.

AKAP10-5 Nucleic Acids and Proteins

The nucleotide sequence of the coding sequence of the predominant allele (i.e., the allele present in the greatest frequency for a given population) of the AKAP-10 gene is presented in SEQ ID NO: 1 and the encoded protein sequence in SEQ ID NO: 2. The nucleotide sequence of the coding sequence of the allelic variant AKAP10-5 is presented as SEQ ID NO: 3 and the corresponding protein sequence as SEQ ID NO: 4.

Also provided is an isolated nucleic acid molecule comprising a sequence of nucleotides that encodes the polypeptide as set forth in SEQ ID NO: 2, except that the Ile residue at position 646 of SEQ ID NO: 2 is replaced with Val, Leu or Phe.

Further provided is an isolated nucleic acid molecule comprising a sequence of nucleotides that encodes the polypeptide as set forth in SEQ ID NO: 2, except that the Ile residue at position 646 of SEQ ID NO: 2 is replaced with Val.

Also provided is an isolated nucleic acid molecule comprising the sequence of nucleotides set forth as position 138 to position 2126 of SEQ ID NO: 1, except that the nucleotide at position 2073 of SEQ ID NO: 1 is replaced with a nucleotide selected from the group consisting of G, T and C.

Further provided is an isolated nucleic acid molecule comprising the sequence of nucleotides set forth as position 138 to position 2126 of SEQ ID NO: 1, except that the nucleotide at position 2073 of SEQ ID NO: 1 is replaced with a G nucleotide.

Further provided is an isolated nucleic acid molecule, comprising a sequence of nucleotides that encodes the polypeptide of SEQ ID NO: 4.

Also provided is an isolated nucleic acid molecule comprising nucleotides from position 138 to position 2126 of SEQ ID NO: 3.

Further provided is an isolated nucleic acid molecule, comprising at least 14 or 16 contiguous nucleotides of SEQ ID NO: 3; wherein the contiguous nucleotides include a sequence of 5 contiguous nucleotides as set forth from position 2069 to position 2077 of SEQ ID NO: 3.

Also provided is an isolated nucleic acid molecule, comprising at least 30 contiguous nucleotides of SEQ ID NO 3; wherein the contiguous nucleotides include a sequence of 5 contiguous nucleotides as set forth from position 2069 to position 2077 of SEQ ID NO: 3.

Also provided is an isolated nucleic acid molecule, comprising at least 50 contiguous nucleotides of SEQ ID NO 3; wherein the contiguous nucleotides include a sequence of 5 contiguous nucleotides as set forth from position 2069 to position 2077 of SEQ ID NO: 3.

Further provided is a polypeptide comprising the sequence of amino acid residues as set forth in SEQ ID NO 2, except that the Ile residue at position 646 of SEQ ID NO 2 is replaced with Val, Leu or Phe.

Also provided is a polypeptide comprising the sequence of amino acid residues as set forth in SEQ ID NO 4.

Further provided is a portion of the polypeptide encoded by the nucleic acid molecule comprising a sequence of nucleotides that encodes the polypeptide as set forth in SEQ ID NO: 2, except that the Ile residue at position 646 of SEQ ID NO: 2 is replaced with Val, Leu or Phe and further comprising at least 5 or 6 amino acid residues and including the replaced residue at position 646 of SEQ ID NO: 2.

Also provided is the polypeptide as described above, wherein the residue at position 646 of SEQ ID NO: 2 is Val.

Further provided are primers, probes or antisense nucleic acid molecules that specifically hybridize adjacent to or at a polymorphic region spanning a position corresponding to position 2073 of SEQ ID NO 1 or 3 of an AKAP10 allele or the complement thereof.

Also provided are such primers, probes or antisense nucleic acid molecules as described above that hybridize under moderate or high conditions.

Further provided is a primer that specifically hybridizes at a position immediately adjacent to a position corresponding to position 2073 of SEQ ID NO: 1 or 3 of an AKAP10 allele.

Also provided is a primer that is extended by a nucleotide that specifically base pairs with the nucleotide at a position corresponding to position 2073 of SEQ ID NO: 3 of an AKAP10 allele.

Further provided are such primers, probes or antisense nucleic acid molecules as described above, that are single-stranded and comprise at least 14 or 16 contiguous nucleotides of the AKAP10 allele or complement thereof, wherein the sequence of nucleotides includes at least 5 contiguous nucleotides from position 2069 to position 2077 of SEQ.ID NO: 3. These primers, probes or antisense nucleic acid molecules can also comprise at least 20 or 30 contiguous nucleotides of SEQ ID NO: 3, or the complement thereof.

Further provided are such primers, probes or antisense nucleic acid molecules as described above, that are single-stranded and comprise at least 14 or 16 contiguous nucleotides of the AKAP10 allele or complement thereof, wherein the nucleic acid molecule includes at least 5 contiguous nucleotides from position 2069 to position 2077 of SEQ ID NO: 1, except that the nucleotide at position 2073 of SEQ ID NO: 1 is replaced with a nucleotide selected from the group consisting of G, T and C.

Further provided are nucleic acid vectors comprising nucleic acid molecules as described above, including a nucleic acid molecule comprising a sequence of nucleotides that encodes the polypeptide as set forth in SEQ ID NO: 2, except that the Ile residue at position 646 of SEQ ID NO: 2 is replaced with Val, Leu or Phe.

Also provided is a primer consisting essentially of the nucleic acid of SEQ ID NO: 15.

Also provided are cells containing the nucleic acid vectors described above.

AKAP10-6 Nucleic Acids

The nucleotide sequence of chromosome 17 containing the genomic sequence of the predominant allele (i.e., the allele present in the greatest frequency for a given population) of the AKAP-10 gene is presented as SEQ ID NO: 17. The nucleotide sequence of chromosome 17 containing the genomic sequence of the allelic variant AKAP10-6 is presented as SEQ ID NO: 13.

Provided herein is an isolated nucleic acid molecule comprising the sequence of nucleotides set forth as nucleotides of position 83,580 to position 156,577 of SEQ ID NO: 17, except that the nucleotide at position 83587 of SEQ ID NO: 17 is replaced with a nucleotide selected from the group consisting of G, A and T.

Further provided is an isolated nucleic acid molecule comprising the sequence of nucleotides set forth as nucleotides of position 83,580 to position 156,577 of SEQ ID NO: 17, except that the nucleotide at position 83587 of SEQ ID NO: 17 is replaced with the nucleotide C.

Also provided is an isolated nucleic acid molecule comprising the sequence of nucleotides set forth as nucleotides of position 83,580 to position 156,577 of SEQ ID NO: 13.

Further provided is an isolated nucleic acid molecule, comprising at least 14 or 16 contiguous nucleotides of SEQ ID NO: 13; wherein the contiguous nucleotides include a sequence of 5 contiguous nucleotides from position 83583 to position 83591 of SEQ ID NO: 13.

Also provided is an isolated nucleic acid molecule, comprising at least 30 contiguous nucleotides of SEQ ID NO: 13; wherein the contiguous nucleotides include a sequence of 5 contiguous nucleotides from position 83583 to position 83591 of SEQ ID NO: 13.

Also provided is an isolated nucleic acid molecule, comprising at least 50 contiguous nucleotides of SEQ ID NO: 13; wherein the contiguous nucleotides include a sequence of 5 contiguous nucleotides from position 83583 to position 83591 of SEQ ID NO: 13.

Further provided are primers, probes or antisense nucleic acid molecules that specifically hybridize adjacent to or at a polymorphic region spanning a position corresponding to position 83587 of SEQ ID NO: 13 or 17 of an AKAP10 allele or the complement thereof.

Also provided are such primers, probes or antisense nucleic acid molecules as described above that hybridize under moderate or high conditions.

Further provided are primers that specifically hybridize at a position immediately adjacent to a position corresponding to position 83587 of SEQ ID NO: 13 or 17 of an AKAP10 allele.

Also provided are primers that are extended by a nucleotide that specifically base pairs with the nucleotide at a position corresponding to position 83587 of SEQ ID NO: 13 of an AKAP10 allele.

Further provided are such primers, probes or antisense nucleic acid molecules as described above, that are single-stranded and comprise at least 14 or 16 contiguous nucleotides of the AKAP10 allele or complement thereof, wherein the nucleic acid molecule includes at least 5 contiguous nucleotides from position 83583 to position 83591 of SEQ ID NO: 13. The primers, probes or antisense nucleic acid molecules can also comprise at least 20 or 30 contiguous nucleotides of SEQ ID NO: 13, or the complement thereof.

Further provided are such primers, probes or antisense nucleic acid molecules as described above, that are single-stranded and comprise at least 14 or 16 contiguous nucleotides of the AKAP10 allele or complement thereof, wherein the nucleic acid molecules include at least 5 contiguous nucleotides from position 83583 to position 83591 of SEQ ID NO: 17, except that the nucleotide at position 83587 of SEQ ID NO 17 is replaced with a nucleotide selected from the group consisting of G, A and T.

Also provided is a primer consisting essentially of the nucleic acid of SEQ ID NO: 19.

Further provided are nucleic acid vectors comprising nucleic acid molecules as described above and cells containing these vectors.

AKAP10-7 Nucleic Acids

The nucleotide sequence of chromosome 17 containing the genomic sequence of the predominant allele (i.e., the allele present in the greatest frequency for a given population) of the AKAP-10 gene is presented as SEQ ID NO: 17. The nucleotide sequence of chromosome 17 containing the genomic sequence of the allelic variant AKAP10-7 is presented as SEQ ID NO: 14.

Provided herein is an isolated nucleic acid molecule comprising the sequence of nucleotides set forth as nucleotides of position 83,580 to position 156,577 of SEQ ID NO: 17, except that the nucleotide at position 129600 of SEQ ID NO: 17 is replaced with a nucleotide selected from the group consisting of A, C and T.

Further provided is an isolated nucleic acid molecule comprising the sequence of nucleotides set forth as nucleotides of position 83,580 to position 156,577 of SEQ ID NO: 17, except that the nucleotide at position 129600 of SEQ ID NO: 17 is replaced with the nucleotide A.

Also provided is an isolated nucleic acid molecule comprising the sequence of nucleotides set forth as nucleotides of position 83,580 to position 156,577 of SEQ ID NO: 14.

Further provided is an isolated nucleic acid molecule, comprising at least 14 or 16 contiguous nucleotides of SEQ. ID. NO 14; wherein the contiguous nucleotides include a sequence of 5 contiguous nucleotides from position 129556 to position 129604 of SEQ. ID. NO: 14.

Also provided is an isolated nucleic acid molecule, comprising at least 30 contiguous nucleotides of SEQ. ID. NO 14; wherein the contiguous nucleotides include a sequence of 5 contiguous nucleotides from position 129556 to position 29604 of SEQ. ID. NO: 14.

Also provided is an isolated nucleic acid molecule, comprising at least 50 contiguous nucleotides of SEQ. ID. NO 14; wherein the contiguous nucleotides include a sequence of 5 contiguous nucleotides from position 129556 to position 129604 of SEQ. ID. NO: 14.

Further provided are primers, probes or antisense nucleic acid molecules that specifically hybridize adjacent to or at a polymorphic region spanning a position corresponding to position 129,600 of SEQ ID NO 14 or 17 of an AKAP10 allele or the complement thereof.

Further provided are primers that specifically hybridize at a position immediately adjacent to a position corresponding to position 129600 of SEQ ID NO: 14 or 17 of an AKAP10 allele.

Also provided are primers that are extended by a nucleotide that specifically base pairs with the nucleotide at a position corresponding to position 129600 of SEQ ID NO: 14 of an AKAP10 allele.

Also provided are such primers, probes or antisense nucleic acid molecules as described above that hybridize under moderate or high conditions.

Further provided are such primers, probes or antisense nucleic acid molecules as described above, that are single-stranded and comprise at least 14 or 16 contiguous nucleotides of the AKAP10 allele or complement thereof, wherein the nucleic acid molecule includes at least 5 contiguous nucleotides from nucleotide position 129556 to position 129604 of SEQ. ID. NO: 14. The primers, probes or antisense nucleic acid molecules can also comprise at least 20 or 30 contiguous nucleotides of SEQ ID NO: 14, or the complement thereof.

Further provided are such primers, probes or antisense nucleic acid molecules as described above, that are single-stranded and comprise at least 14 or 16 contiguous nucleotides of the AKAP10 allele or complement thereof, wherein the nucleic acid molecule includes at least 5 contiguous nucleotides from nucleotide position 129556 to position 129604 of SEQ. ID. NO: 17, except that the nucleotide at position 129600 of SEQ ID NO: 17 is replaced with a nucleotide selected from the group consisting of A, C and T.

Also provided is a primer consisting essentially of the nucleic acid of SEQ ID NO: 20.

Further provided are nucleic acid vectors comprising nucleic acid molecules as described above and cells containing these vectors.

Methods for Detection of AKAP10 Allelic Variants

Also provided are methods for determining the presence or absence of an allelic variant of a human AKAP10 gene, comprising determining the identity of the nucleotide at a position corresponding to position 2073 (of SEQ ID NO: 1) of the coding sequence of a human AKAP10 gene or the complement thereof, wherein the variant has a nucleotide other than A at a position corresponding to position 2073 (of SEQ ID NO 1).

Further provided is a method comprising hybridizing a target nucleic acid comprising a human AKAP10-encoding nucleic acid or fragment thereof or a complement of a human AKAP10-encoding nucleic acid or fragment thereof with a nucleic acid primer that hybridizes adjacent to a position corresponding to position 2073 (of SEQ ID NO: 1) of the coding sequence of the human AKAP10 gene or the complement thereof; extending the nucleic acid primer using the target nucleic acid as a template; and determining the mass of the extended primer to identify the nucleotide present at a position corresponding to position 2073 or the complement thereof, thereby determining the presence or absence of the allelic variant. The mass of the extended primer can be determined by mass spectrometry.

Further provided is a method that includes the steps of hybridizing a target nucleic acid comprising a human AKAP10-encoding nucleic acid or fragment thereof with a nucleic acid primer that hybridizes adjacent to a position corresponding to position 2073 (of SEQ ID NO: 1) of the coding sequence of the human AKAP10 gene or the complement thereof; extending the nucleic acid primer using the target nucleic acid as a template in the presence of at least one dideoxynucleotide; and determining the mass of the extended primer to identify the nucleotide present at a position corresponding to position 2073 or the complement thereof, thereby determining the presence or absence of an allelic variant. The dideoxynucleotide can be, but are not limited to, ddT or ddA. The primer can also be extended in the presence at least two dideoxynucleotides which are ddT and ddC or ddA and ddG. The mass of the extended primer can be determined by mass spectrometry. Also provided are the above described methods wherein hybridization is effected under conditions of high stringency.

Further provided is a method for detecting the presence or absence of an allelic variant of a human AKAP10 gene, comprising determining the identity of the nucleotide at a position corresponding to position 2073 (of SEQ ID NO: 1) of the coding sequence of a human AKAP10 gene or the complement thereof, wherein a variant has a nucleotide other than A at a position corresponding to position 2073 comprising hybridizing a target nucleic acid comprising a human AKAP10-encoding nucleic acid, complement thereof or fragment thereof with a single-stranded nucleic acid probe at a position corresponding to position 2073 of the coding sequence of the human AKAP10 gene or complement thereof; and detecting hybridized probe to identify the nucleotide present at a position corresponding to position 2073 or the complement thereof, thereby determining the presence or absence of an allelic variant.

Further provided is a method as described above wherein hybridization is effected under conditions of high stringency.

Also provided is a method as described above, wherein the nucleotide of the probe that hybridizes with the nucleotide at a position corresponding to position 2073 is complementary to a G, T, or C nucleotide or the nucleotide of the probe that hybridizes with the nucleotide at the complement of a position corresponding to position 2073 is complementary to a G, A, or C nucleotide.

Also provided are methods where the nucleotide detected at a position corresponding to position 2073 is a G and where the nucleotide detected at the complement of a position corresponding to position 2073 is a C.

Further provided are methods as described above to determine the presence or absence of other allelic variants of the human AKAP10 gene at polymorphic regions corresponding to position 83587 (a nucleotide other than C), corresponding to position 129600 (a nucleotide other than G) and corresponding to position 156,277 (a nucleotide other than T) of SEQ ID NO: 17.

Methods for Determining Susceptibility to Morbidity and/or Increased or Early Mortality Also provided are methods for determining susceptibility to morbidity, increased or early mortality, or morbidity and increased or early mortality of a subject. These methods include the steps of detecting the presence or absence of at least one allelic variant of a polymorphic region of an AKAP10 gene that is associated with susceptibility to morbidity, increased or early mortality, or morbidity and increased or early mortality; wherein the predominant allele comprises an A at a position corresponding to position 2073 of SEQ ID NO: 1, and the presence of the allelic variant is indicative of increased susceptibility to morbidity, increased or early mortality, or morbidity and increased or early mortality as compared to the susceptibility of a subject who does not comprise the allelic variant. The polymorphic region of the AKAP10 gene can comprise a nucleotide other than an A at a position corresponding to position 2073 of the coding sequence of the AKAP10 gene or other than a T of the complement of the coding sequence of the AKAP10 gene.

Other polymorphic regions of the AKAP10 gene representing allelic variants of the AKAP10 gene that are associated with susceptibility to morbidity, increased or early mortality, or morbidity and increased or early mortality comprise a nucleotide other than a C at a position corresponding to position 83587 of the SEQ ID NO: 17 or other than a G on the complementary strand, a nucleotide other than a G at a position corresponding to position 129600 of the SEQ ID NO: 17 or other than a C on the complementary strand and a nucleotide other than T at a position corresponding to position 156,277 of SEQ ID NO: 17 or other than A on the complementary strand.

The detection of the presence or absence of an allelic variant can be effected by, but is not limited to, methods such as allele specific hybridization, primer specific extension, oligonucleotide ligation assay, restriction enzyme site analysis and single-stranded conformation polymorphism analysis. The detection can further be effected, but is not limited to, by mass spectrometry or by a signal moiety such as radioisotopes, enzymes, antigens, antibodies, spectrophotometric reagents, chemiluminescent reagents, fluorescent reagents and other light producing reagents.

A collection of polymorphic regions of the AKAP10 gene that individually represent allelic variants associated with morbidity, increased or early mortality, or morbidity and increased or early mortality in a subject may be more informative than a single allelic variant. Each allelic variant may be assayed individually or the collection may be assayed simultaneously using multiplex assay methods. Further provided is a collection of polymorphic regions of the AKAP10 gene comprising at least two polymorphic regions selected from the group consisting of a position corresponding to position 2073 of SEQ ID NO 3, a position corresponding to position 83587 of SEQ ID NO: 13, a position corresponding to position 129,600 of SEQ ID NO: 14 and a position corresponding to position 156,277 of SEQ ID NO: 18.

Cells

Further provided is a cell comprising a heterologous nucleic acid, that encodes a human AKAP-10 variant protein or portion thereof that exhibits a biological activity of the full length variant protein, wherein the AKAP-10 protein or portion thereof comprises valine at a position corresponding to amino acid residue position 646 of SEQ ID NO 2.

Also provided is a cell that contains a heterologous nucleic acid, that encodes the amino acid sequence set forth in SEQ. ID. NO: 4.

Further provided is a cell comprising a heterologous nucleic acid, that comprises the sequence of nucleotides as set forth from position 138 to position 2126 of SEQ. ID. NO: 3.

Also provided is a cell comprising a heterologous nucleic acid, that comprises the sequence of nucleotides as set forth from position 83580 to position 156,577 of SEQ. ID. NO: 13.

Further provided is a cell comprising a heterologous nucleic acid, that comprises the sequence of nucleotides as set forth from position 83580 to position 156,577 of SEQ. ID. NO: 14.

Also provided is a cell comprising a heterologous nucleic acid, that comprises the sequence of nucleotides as set forth from position 83580 to position 156,577 of SEQ ID NO: 18.

Kits

Further provided are kits for determining whether a subject has an increased susceptibility to morbidity and/or a predisposition for premature or increased or early mortality, comprising a first primer or probe that specifically hybridizes adjacent to or at a polymorphic region spanning a position corresponding to position 2073 of SEQ ID NO 1 or 3 of an AKAP10 allele or the complement thereof and a second primer or probe that specifically hybridizes adjacent to or at a polymorphic region spanning a position corresponding to positions selected from the group consisting of position 83587 of SEQ ID NO 13 or 17, position 129600 of SEQ ID NO 14 or 17, and position 156,277 of SEQ ID NO 18 or 17 of an AKAP10 allele or the complement thereof. Primers include, but are not limited to, nucleic acids consisting essentially of the nucleotide sequence of SEQ ID NO: 8, SEQ ID NO: 15, SEQ ID NO: 19 and SEQ ID NO 20. The kits also optionally contain instructions for carrying out assays, interpreting results or for aid in determining if a subject has a predisposition for an increased susceptibility to morbidity and/or a predisposition for premature or increased or early mortality. The kits can also include at least one didieoxynucleotide such as ddA, ddC, ddG.

Proteins and Methods of Producing

Further provided is a method of producing a protein by growing a cell comprising a nucleic acid vector comprising a nucleic acid molecule, comprising a sequence of nucleotides that encodes the polypeptide of SEQ ID NO: 2, except that the Ile residue at position 646 of SEQ ID NO: 2 is replaced with Val, Leu or Phe, under conditions whereby the protein is expressed and isolating the protein.

Also provided are methods wherein the cell is a mammalian cell, yeast cell, insect cell, bacterial cell or human cell.

Further provided are proteins produced by the above described methods.

Transgenic Animals

Also provided are transgenic animals comprising heterologous nucleic acid encoding a human AKAP10 protein or portion thereof comprising the binding region for protein kinase A, wherein the AKAP10 protein or portion thereof comprises valine at a position corresponding to position 646 of SEQ ID NO: 2, wherein the transgenic nucleotide acid is expressed; and, as a result of the expression, the transgenic animal has an alteration in cellular signal transduction. The transgenic animals include, but are not limited to, rodents, including rats and mice.

Further provided are transgenic animals comprising heterologous nucleic acid encoding the sequence of an allelic variant of a human AKAP10 gene comprising a nucleotide other than a C at a position corresponding with position 83587 of the SEQ ID NO: 17, a nucleotide other than a G at a position corresponding to position 129600 of the SEQ ID NO: 17 or a nucleotide other than T at position corresponding to position 156,277 of SEQ ID NO: 17.

Methods to Identify Molecules that Modulate the Activity of AKAP10 Variant Proteins and Nucleic Acids Further provided are methods for identifying a molecule that modulates the biological activity of an AKAP10 protein, comprising combining the candidate molecule with a cell comprising a nucleotide sequence encoding an AKAP10 variant protein or portion thereof that retains a biological activity of the full length variant protein and which has an amino acid residue at a position corresponding to position 646 of SEQ ID NO: 2 which is not Ile, operably linked to a promoter such that the nucleotide sequence is expressed as an AKAP protein or portion thereof in the cell and determining the affect of the molecule upon the biological activity of the AKAP10 protein or portion thereof.

Also provided are methods as described above in which the activity of the AKAP10 protein or portion thereof is determined by examining signal transduction in the cell or by examining binding of AKAP10 protein or portion thereof to protein kinase A or by examining cellular phosphorylation.

Nucleic acid encoding the sequence of other allelic variant of a human AKAP10 gene, that are not in coding regions, can be introduced into cells allowing for the identification of molecules that may modulate the expression of these sequences at the level of transcription, translation or processing. Such sequences of other allelic variant of a human AKAP10 gene can comprise a nucleotide other than a C at a position corresponding with position 83587 of the SEQ ID NO: 17, a nucleotide other than a G at a position corresponding to position 129600 of the SEQ ID NO: 17 or a nucleotide other than T at position corresponding to position 156,277 of SEQ ID NO: 17. Assays to monitor transcription, translation and processing are familiar to produce in the field.

Methods for Indicating and/or Predicting a Susceptibility to an Alteration in Signal Transduction Further provided are methods for indicating an alteration in signal transduction and/or predicting a susceptibility to an alteration in signal transduction in a subject comprising detecting the presence or absence of an allelic variant of an AKAP10 gene having a nucleotide other than A at a position corresponding to position 2073 of SEQ ID NO: 1, wherein the presence of a nucleotide other than A is indicative of an alteration in signal transduction.

Also provided are methods as described above wherein the allelic variant has a G at a position corresponding to position 2073 of SEQ ID NO: 1.

Other polymorphic regions of the AKAP10 gene representing allelic variants of the AKAP10 gene that are associated with an alteration in signal transduction comprise a nucleotide other than a C at a position corresponding with position 83587 of the SEQ ID NO: 17 or other than a G on the complementary strand, a nucleotide other than a G at a position corresponding to position 129600 of the SEQ ID NO: 17 or other than a C on the complementary strand and a nucleotide other than T at position corresponding to position 156,277 of SEQ ID NO: 17 or other than A on the complementary strand.

Further provided are methods which also comprise detecting the presence or absence of an allelic variant at another polymorphic position of the AKAP10 gene selected from the group consisting of a position corresponding to position 83587 of SEQ ID NO: 13, a position 129,600 of SEQ ID NO: 14 and position 156,277 of SEQ ID NO: 18.

The alteration in signal transduction maybe related to disorders such as cardiovascular disorders, cardiac disorders, proliferative disorders, neurological disorders, neurodegenerative disorders, obesity, diabetes and peripheral retinopathies, Alzheimer's disease, altered left ventricular function, cardiomyopathies, bipolar disorder and retinitis pigmentosa.

Further provided are the above described methods for which the detecting step is by allele specific hybridization, primer specific extension, oligonucleotide ligation assay, restriction enzyme site analysis and single-stranded conformation polymorphism analysis.

Also provided are methods wherein the detecting is effected by mass spectrometry.

Further provided are methods wherein the detecting is effected by a signal moiety such as radioisotopes, enzymes, antigens, antibodies, spectrophotometric reagents, chemiluminescent reagents, fluorescent reagents and other light producing reagents.

Supports

Also provided is a solid support comprising a nucleic acid comprising a polymorphic region of an AKAP10 gene, wherein the polymorphic regions comprises a nucleotide at a position corresponding to position 2073 of SEQ ID NO: 1 that is other than an A or other than T on the complementary strand.

Further provided is a solid support comprising a nucleic acid comprising a polymorphic region of an AKAP10 gene, wherein the polymorphic regions comprises a nucleotide at a position corresponding to position 83587 of SEQ ID NO: 17 that is other than a C or other than G on the complementary strand.

Also provided is a solid support comprising a nucleic acid comprising a polymorphic region of an AKAP10 gene, wherein the polymorphic regions comprises a nucleotide at a position corresponding to position 129600 of SEQ ID NO 17 that is other than a G or other than C on the complementary strand.

Also provided is a solid support comprising a nucleic acid comprising a polymorphic region of an AKAP10 gene, wherein the polymorphic regions comprises a nucleotide at a position corresponding to position 156,277 of SEQ ID NO: 17 that is other than T or other than A on the complementary strand.

Further provided is a solid support comprising a nucleic acid comprising a polymorphic region of an AKAP10 gene which is a microarray.

Also provided is a microarray comprising at least 2 nucleic acid molecules each comprising a sequence of a polymorphic region of an AKAP10 gene at a position corresponding the position of the group consisting position 2073 of SEQ ID NO: 3, position 83587 of SEQ ID NO: 13, position 129,600 of SEQ ID NO: 14 and position 156,277 of SEQ ID NO: 18., or the compliments thereof.

Microarrays are well known (see, e.g., U.S. Pat. Nos. 5,837,832; 5,858,659; 6,043,136; 6,043,031 and 6,156,501).

Ribozymes

Also provided is an anti-AKAP10 ribozyme comprising a sequence complementary to a polymorphic region of an AKAP10 gene. The polymorphic regions are selected from the group consisting of a position corresponding to position 2073 of SEQ ID NO: 3, position 83587 of SEQ ID NO: 13, position 129,600 of SEQ ID NO: 14 and position 156,277 of SEQ ID NO: 18.

Further provided is a ribozyme comprising the nucleic acid of SEQ ID NO: 25.

DETAILED DESCRIPTION OF PREFERRED EMBODIMENTS

A. Definitions

Unless defined otherwise, all technical and scientific terms used herein have the same meaning as is commonly understood by one of skill in the art to which this invention belongs. All patents, patent applications, published applications and publications referred to throughout the disclosure herein are, unless noted otherwise, incorporated by reference in their entirety. In the event that there are a plurality of definitions for terms herein, those in this section prevail.

As used herein, sequencing refers to the process of determining a nucleotide sequence and can be performed using any method known to those of skill in the art. For example, if a polymorphism is identified or known, and it is desired to assess its frequency or presence in nucleic acid samples taken from the subjects that comprise the database, the region of interest from the samples can be isolated, such as by PCR or restriction fragments, hybridization or other suitable method known to those of skill in the art, and sequenced. For purposes herein, sequencing analysis is preferably effected using mass spectrometry (see, e.g., U.S. Pat. Nos. 5,547,835, 5,622,824, 5,851,765, and 5,928,906). Nucleic acids can also be sequenced by hybridization (see, e.g., U.S. Pat. Nos. 5,503,980, 5,631,134, 5,795,714) and including analysis by mass spectrometry (see, U.S. application Ser. Nos. 08/419,994 and 09/395,409). Alternatively, sequencing may be performed using other known methods, such as set forth in U.S. Pat. Nos. 5,525,464; 5,695,940; 5,834,189; 5,869,242; 5,876,934; 5,908,755; 5,912,118; 5,952,174; 5,976,802; 5,981,186; 5,998,143; 6,004,744; 6,017,702; 6,018,041; 6,025,136; 6,046,005; 6,087,095; 6,117,634, 6,013,431, WO 98/30883; WO 98/56954; WO 99/09218; WO/00/58519, and the others.

As used herein, "polymorphism" refers to the coexistence of more than one form of a gene or portion thereof. A portion of a gene of which there are at least two different forms, i.e., two different nucleotide sequences, is referred to as a "polymorphic region of a gene". A polymorphic region can be a single nucleotide, the identity of which differs in different alleles. A polymorphic region can also be several nucleotides in length.

As used herein, "polymorphic gene" refers to a gene having at least one polymorphic region.

As used herein, "allele", which is used interchangeably herein with "allelic variant" refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene. Alleles of a specific gene can differ from each other in a single nucleotide, or several nucleotides, and can include substitutions, deletions, and insertions of nucleotides. An allele of a gene can also be a form of a gene containing a mutation.

As used herein, "predominant allele" refers to an allele that is represented in the greatest frequency for a given population. The allele or alleles that are present in lesser frequency are referred to as allelic variants.

As used herein, "associated" refers to coincidence with the development or manifestation of a disease, condition or phenotype. Association may be due to, but is not limited to, genes responsible for housekeeping functions whose alteration can provide the foundation for a variety of diseases and conditions, those that are part of a pathway that is involved in a specific disease, condition or phenotype and those that indirectly contribute to the manifestation of a disease, condition or phenotype.

As used herein, the term "subject" refers to mammals and in particular human beings.

As used herein, the term "gene" or "recombinant gene" refers to a nucleic acid molecule comprising an open reading frame and including at least one exon and (optionally) an intron sequence. A gene can be either RNA or DNA. Genes may include regions preceding and following the coding region (leader and trailer).

As used herein, "intron" refers to a DNA sequence present in a given gene which is spliced out during mRNA maturation.

As used herein, "nucleotide sequence complementary to the nucleotide sequence set forth in SEQ ID NO: x" refers to the nucleotide sequence of the complementary strand of a nucleic acid strand having SEQ ID NO: x. The term "complementary strand" is used herein interchangeably with the term "complement". The complement of a nucleic acid strand can be the complement of a coding strand or the complement of a non-coding strand. When referring to double stranded nucleic acids, the complement of a nucleic acid having SEQ ID NO: x refers to the complementary strand of the strand having SEQ ID NO: x or to any nucleic acid having the nucleotide sequence of the complementary strand of SEQ ID NO: x. When referring to a single stranded nucleic acid having the nucleotide sequence SEQ ID NO: x, the complement of this nucleic acid is a nucleic acid having a nucleotide sequence which is complementary to that of SEQ ID NO: x.

As used herein, the term "coding sequence" refers to that portion of a gene that encodes an amino acid sequence of a protein.

As used herein, the term "sense strand" refers to that strand of a double-stranded nucleic acid molecule that has the sequence of the mRNA that encodes the amino acid sequence encoded by the double-stranded nucleic acid molecule.

As used herein, the term "antisense strand" refers to that strand of a double-stranded nucleic acid molecule that is the complement of the sequence of the mRNA that encodes the amino acid sequence encoded by the double-stranded nucleic acid molecule.

As used herein, the amino acids, which occur in the various amino acid sequences appearing herein, are identified according to their well-known, three-letter or one-letter abbreviations. The nucleotides, which occur in the various DNA fragments, are designated with the standard single-letter designations used routinely in the art (see, Table 1).

As used herein, amino acid residue refers to an amino acid formed upon chemical digestion (hydrolysis) of a polypeptide at its peptide linkages. The amino acid residues described herein are preferably in the "L" isomeric form. However, residues in the "D" isomeric form can be substituted for any L-amino acid residue, as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243:3552–59 (1969) and adopted at 37 C.F.R. §§ 1.821–1.822, abbreviations for amino acid residues are shown in the following Table:

TABLE 1

Table of Correspondence

| SYMBOL | | |
|---|---|---|
| 1-Letter | 3-Letter | AMINO ACID |
| Y | Tyr | tyrosine |
| G | Gly | glycine |
| F | Phe | phenylalanine |
| M | Met | methionine |
| A | Ala | alanine |
| S | Ser | serine |
| I | Ile | isoleucine |
| L | Leu | leucine |
| T | Thr | threonine |
| V | Val | valine |
| P | Pro | proline |
| K | Lys | lysine |
| H | His | histidine |
| Q | Gln | glutamine |
| E | Glu | glutamic acid |
| Z | Glx | Glu and/or Gln |
| W | Trp | tryptophan |
| R | Arg | arginine |
| D | Asp | aspartic acid |
| N | Asn | asparagine |
| B | Asx | Asn and/or Asp |
| C | Cys | cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence and modified and unusual amino acids, such as those referred to in 37 C.F.R. §§ 1.821–1.822, and incorporated herein by reference. Furthermore, it should be noted that a dash at the beginning or end of an amino acid residue sequence indicates a peptide bond to a further sequence of one or more amino acid residues or to an amino-terminal group such as $NH_2$ or to a carboxyl-terminal group such as COOH.

In a peptide or protein, suitable conservative substitutions of amino acids are known to those of skill in this art and may be made generally without altering the biological activity of the resulting molecule. Those of skill in this art recognize that, in general, single amino acid substitutions in non-essential regions of a polypeptide do not substantially alter biological activity (see, e.g., Watson et al. *Molecular Biology of the Gene*, 4th Edition, 1987, The Benjamin/Cummings Pub. co., p.224).

Such substitutions are preferably made in accordance with those set forth in TABLE 2 as follows:

TABLE 2

| Original residue | Conservative substitution |
|---|---|
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions are also permissible and may be determined empirically or in accord with known conservative substitutions.

As used herein, a DNA or nucleic acid homolog refers to a nucleic acid that includes a preselected conserved nucleotide sequence, such as a sequence encoding a therapeutic polypeptide. By the term "substantially homologous" is meant having at least 80%, preferably at least 90%, most preferably at least 95% homology therewith or a less percentage of homology or identity and conserved biological activity or function.

The terms "homology" and "identity" are often used interchangeably. In this regard, percent homology or identity may be determined, for example, by comparing sequence information using a GAP computer program. The GAP program uses the alignment method of Needleman and Wunsch (*J. Mol. Biol.* 48:443 (1970), as revised by Smith and Waterman (*Adv. Appl. Math.* 2:482 (1981). Briefly, the GAP program defines similarity as the number of aligned symbols (i.e., nucleotides or amino acids) which are similar, divided by the total number of symbols in the shorter of the two sequences. The preferred default parameters for the GAP program may include: (1) a unary comparison matrix (containing a value of 1 for identities and 0 for non-identities) and the weighted comparison matrix of Gribskov and Burgess, *Nucl. Acids Res.* 14:6745 (1986), as described by Schwartz and Dayhoff, eds., ATLAS OF PROTEIN SEQUENCE AND STRUCTURE, National Biomedical Research Foundation, pp. 353–358 (1979); (2) a penalty of 3.0 for each gap and an additional 0.10 penalty for each symbol in each gap; and (3) no penalty for end gaps.

Whether any two nucleic acid molecules have nucleotide sequences that are at least 80%, 85%, 90%, 95%, 96%, 97%, 98% or 99% "identical" can be determined using known computer algorithms such as the "FAST A" program, using for example, the default parameters as in Pearson and Lipman, *Proc. Natl. Acad. Sci. USA* 85:2444 (1988). Alternatively the BLAST function of the National Center for Biotechnology Information database may be used to determine identity In general, sequences are aligned so that the highest order match is obtained. "Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). While there exist a number of methods to measure identity between two polynucleotide or polypeptide sequences, the term "identity" is well known to skilled artisans (Carillo, H. & Lipton, D., *SIAM J Applied Math* 48:1073 (1988)). Methods commonly employed to determine identity or similarity between two sequences include, but are not limited to, those disclosed in Guide to Human Genome Computing, Martin J. Bishop, ed., Academic Press, San Diego, 1994, and Carillo, H. & Lipton, D., *SIAM J Applied Math* 48:1073 (1988). Methods to determine identity and similarity are codified in computer programs. Preferred computer program methods to determine identity and similarity between two sequences include, but are not limited to, GCG program package (Devereux, J., et al., *Nucleic Acids Research* 12(I):387 (1984)), BLASTP, BLASTN, FASTA (Atschul, S. F., et al., *J Molec Biol* 215:403 (1990)).

Therefore, as used herein, the term "identity" represents a comparison between a test and a reference polypeptide or polynucleotide. For example, a test polypeptide may be defined as any polypeptide that is 90% or more identical to a reference polypeptide.

As used herein, the term at least "90% identical to" refers to percent identities from 90 to 99.99 relative to the reference polypeptides. Identity at a level of 90% or more is indicative of the fact that, assuming for exemplification purposes a test and reference polynucleotide length of 100 amino acids are compared. No more than 10% (i.e., 10 out of 100) amino acids in the test polypeptide differs from that of the reference polypeptides. Similar comparisons may be made between a test and reference polynucleotides. Such differences may be represented as point mutations randomly distributed over the entire length of an amino acid sequence or they may be clustered in one or more locations of varying length up to the maximum allowable, e.g. 10/100 amino acid difference (approximately 90% identity). Differences are defined as nucleic acid or amino acid substitutions, or deletions.

As used herein, stringency conditions refer to the washing conditions for removing the non-specific probes and conditions that are equivalent to either high, medium, or low stringency as described below:

1) high stringency: 0.1×SSPE, 0.1% SDS, 65° C.
2) medium stringency: 0.2×SSPE, 0.1% SDS, 50° C.
3) low stringency: 1.0×SSPE, 0.1% SDS, 50° C.

It is understood that equivalent stringencies may be achieved using alternative buffers, salts and temperatures.

As used herein, "heterologous DNA" is DNA that encodes RNA and proteins that are not normally produced in vivo by the cell in which it is expressed or that mediates or encodes mediators that alter expression of endogenous DNA by affecting transcription, translation, or other regulatable biochemical processes or is not present in the exact orientation or position as the counterpart DNA in a wildtype cell. Heterologous DNA may also be referred to as foreign DNA. Any DNA that one of skill in the art would recognize or consider as heterologous or foreign to the cell in which is expressed is herein encompassed by heterologous DNA. Examples of heterologous DNA include, but are not limited to, DNA that encodes traceable marker proteins, such as a protein that confers drug resistance, DNA that encodes therapeutically effective substances, such as anti-cancer agents, enzymes and hormones, and DNA that encodes other types of proteins, such as antibodies. Antibodies that are encoded by heterologous DNA may be secreted or expressed on the surface of the cell in which the heterologous DNA has been introduced.

As used herein, isolated with reference to a nucleic acid molecule or polypeptide or other biomolecule means that the nucleic acid or polypeptide has separated from the genetic environment from which the polypeptide or nucleic acid were obtained. It may also mean altered from the natural state. For example, a polynucleotide or a polypeptide naturally present in a living animal is not "isolated," but the same polynucleotide or polypeptide separated from the coexisting materials of its natural state is "isolated", as the term is employed herein. Thus, a polypeptide or polynucleotide produced and/or contained within a recombinant host cell is considered isolated. Also intended as an "isolated polypeptide" or an "isolated polynucleotide" are polypeptides or polynucleotides that have been purified, partially or substantially, from a recombinant host cell or from a native source. For example, a recombinantly produced version of a compounds can be substantially purified by the one-step method described in Smith and Johnson, *Gene* 67:31–40 (1988). The terms isolated and purified are sometimes used interchangeably.

Thus, by "isolated" is meant that the nucleic acid is free of the coding sequences of those genes that, in the naturally-occurring genome of the organism (if any) immediately flank the gene encoding the nucleic acid of interest. Isolated DNA may be single-stranded or double-stranded, and may be genomic DNA, cDNA, recombinant hybrid DNA, or synthetic DNA. It may be identical to a native DNA sequence, or may differ from such sequence by the deletion, addition, or substitution of one or more nucleotides.

Isolated or purified as it refers to preparations made from biological cells or hosts means any cell extract containing the indicated DNA or protein including a crude extract of the DNA or protein of interest. For example, in the case of a protein, a purified preparation can be obtained following an individual technique or a series of preparative or biochemical techniques and the DNA or protein of interest can be present at various degrees of purity in these preparations. The procedures may include for example, but are not limited to, ammonium sulfate fractionation, gel filtration, ion exchange change chromatography, affinity chromatography, density gradient centrifugation and electrophoresis.

A preparation of DNA or protein that is "substantially pure" or "isolated" should be understood to mean a preparation free from naturally occurring materials with which such DNA or protein is normally associated in nature. "Essentially pure" should be understood to mean a "highly" purified preparation that contains at least 95% of the DNA or protein of interest.

A cell extract that contains the DNA or protein of interest should be understood to mean a homogenate preparation or cell-free preparation obtained from cells that express the protein or contain the DNA of interest. The term "cell extract" is intended to include culture media, especially spent culture media from which the cells have been removed.

As used herein, receptor refers to a biologically active molecule that specifically binds to (or with) other molecules. The term "receptor protein" may be used to more specifically indicate the proteinaceous nature of a specific receptor.

As used herein, recombinant refers to any progeny formed as the result of genetic engineering.

As used herein, a promoter region refers to the portion of DNA of a gene that controls transcription of the DNA to which it is operatively linked. The promoter region includes specific sequences of DNA that are sufficient for RNA polymerase recognition, binding and transcription initiation. This portion of the promoter region is referred to as the promoter. In addition, the promoter region includes sequences that modulate this recognition, binding and transcription initiation activity of the RNA polymerase. These sequences may be cis acting or may be responsive to trans acting factors. Promoters, depending upon the nature of the regulation, may be constitutive or regulated.

As used herein, the phrase "operatively linked" generally means the sequences or segments have been covalently joined into one piece of DNA, whether in single or double stranded form, whereby control or regulatory sequences on one segment control or permit expression or replication or other such control of other segments. The two segments are not necessarily contiguous. For gene expression a DNA sequence and a regulatory sequence(s) are connected in such a way to control or permit gene expression when the appropriate molecular, e.g., transcriptional activator proteins, are bound to the regulatory sequence(s).

As used herein, production by recombinant means by using recombinant DNA methods means the use of the well known methods of molecular biology for expressing proteins encoded by cloned DNA, including cloning expression of genes and methods, such as gene shuffling and phage display with screening for desired specificities.

As used herein, the term "conjugated" refers stable attachment, such as ionic or covalent attachment.

As used herein, a composition refers to any mixture of two or more products or compounds. It may be a solution, a suspension, liquid, powder, a paste, aqueous, non-aqueous or any combination thereof.

As used herein, a combination refers to any association between two or more items.

As used herein, substantially identical to a product means sufficiently similar so that the property of interest is sufficiently unchanged so that the substantially identical product can be used in place of the product.

As used herein, the term "vector" refers to a nucleic acid molecule capable of transporting another nucleic acid to which it has been linked. One type of preferred vector is an episome, i.e., a nucleic acid capable of extra-chromosomal replication. Preferred vectors are those capable of autonomous replication and/or expression of nucleic acids to which they are linked. Vectors capable of directing the expression of genes to which they are operatively linked are referred to herein as "expression vectors". In general, expression vectors of utility in recombinant DNA techniques are often in the form of "plasmids" which refer generally to circular double stranded DNA loops which, in their vector form are not bound to the chromosome. "Plasmid" and "vector" are used interchangeably as the plasmid is the most commonly used form of vector. Other such other forms of expression vectors that serve equivalent functions and that become known in the art subsequently hereto.

As used herein, "indicating" or "determining" means that the presence or absence of an allelic variant may be one of many factors that are considered when a subject's predisposition to a disease or disorder is evaluated. Thus a predisposition to a disease or disorder is not necessarily conclusively determined by only ascertaining the presence or absence of one or more allelic variants, but the presence of one of more of such variants is among a number of factors considered.

As used herein, "predisposition to develop a disease or disorder" means that a subject having a particular genotype and/or haplotype has a higher likelihood than one not having such a genotype and/or haplotype for developing a particular disease or disorder.

As used herein, "morbidity" refers to conditions, such as diseases or disorders, that compromise the health and wellbeing of an organism, such as an animal. Morbidity susceptibility or morbidity-associated genes are genes that, when altered, for example, by a variation in nucleotide sequence, facilitate the expression of a specific disease clinical phenotype. Thus, morbidity susceptibility genes have the potential, upon alteration, of increasing the likelihood or general risk that an organism will develop a specific disease.

As used herein, "mortality" refers to the statistical likelihood that an organism, particularly an animal, will not survive a full predicted lifespan. Hence, a trait or a marker, such as a polymorphism, associated with increased mortality is observed at a lower frequency in older than younger segments of a population.

As used herein, "transgenic animal" refers to any animal, preferably a non-human animal, e.g. a mammal, bird or an amphibian, in which one or more of the cells of the animal contain heterologous nucleic acid introduced by way of human intervention, such as by transgenic techniques well known in the art. The nucleic acid is introduced into the cell, directly or indirectly by introduction into a precursor of the cell, by way of deliberate genetic manipulation, such as by microinjection or by infection with a recombinant virus. The term genetic manipulation does not include classical crossbreeding, or in vitro fertilization, but rather is directed to the introduction of a recombinant DNA molecule. This molecule may be integrated within a chromosome, or it may be extrachromosomally replicating DNA. In the typical transgenic animals described herein, the transgene causes cells to express a recombinant form of a protein. However, transgenic animals in which the recombinant gene is silent are also contemplated, as for example, using the FLP or CRE recombinase dependent constructs. Moreover, "transgenic animal" also includes those recombinant animals in which gene disruption of one or more genes is caused by human intervention, including recombination and antisense techniques.

As used herein, "target nucleic acid" refers to a nucleic acid molecule which contains all or a portion of a polymorphic region of a gene of interest.

As used herein, "signal moiety" refers to any moiety that allows for the detection of a nucleic acid molecule. Included are moieties covalently attached to nucleic acids and those that are not.

As used herein, "molecule that modulates or effects the biological activity of an AKAP10 protein" refers to any drug, small molecule, nucleic acid (sense and antisense), ribozyme, protein, peptide, lipid, carbohydrate etc. or combination thereof, that directly or indirectly changes, alters, abolishes, increases or decreases a biological activity attributed to AKAP10 protein.

As used herein, "biological activity of an AKAP10 protein" refers to, but is not limited to, binding of AKAP10 to protein kinase A or its subunits, localization of AKAP10 protein to a subcellular site, e.g., the mitochondria, localization of protein kinase A to the mitochondria and binding of AKAP10 protein to other proteins including other signalling enzymes.

As used herein, "combining" refers to contacting the biologically active agent with a cell or animal such that the agent is introduced into the cell or animal. For a cell any method that results in an agent traversing the plasma membrane is useful. For an animal any of the standard routes of administration of an agent, e.g. oral, rectal, transmucosal, intestinal, intravenous, intraperitoneal, intraventricular, subcutaneous, intramuscular, etc., can be used.

As used herein, a composition refers to any mixture. It may be a solution, a suspension, liquid, powder, a paste, aqueous, non-aqueous or any combination thereof.

As used herein, a combination refers to any association between two or among more items.

As used herein, "kit" refers to a package that contains a combination, such as one or more primers or probes used to amplify or detect polymorphic regions of AKAP10 genes, optionally including instructions and/or reagents for their use.

As used herein, "solid support" refers to a support substrate or matrix, such as silica, polymeric materials or glass. At least one surface of the support can be partially planar. Regions of the support may be physically separated, for example with trenches, grooves, well or the like. Some examples of solid supports include slides and beads. Supports are of such composition so as to allow for the immobilization or attachment of nucleic acids and other molecules such that these molecules retain their binding ability.

As used herein, "array" refers to a collection of elements, such as nucleic acids, containing three or more members. An addressable array is one in which the members of the array are identifiable, typically by position on a solid support. Hence, in general the members of the array will be immobilized to discrete identifiable loci on the surface of a solid phase.

As used herein, "specifically hybridizes" refers to hybridization of a probe or primer only to a target sequence preferentially to a non-target sequence. Those of skill in the art are familiar with parameters that affect hybridization; such as temperature, probe or primer length and composition, buffer composition and salt concentration and can readily adjust these parameters to achieve specific hybridization of a nucleic acid to a target sequence.

As used herein "nucleic acid" refers to polynucleotides such as deoxyribonucleic acid (DNA) and ribonucleic acid (RNA). The term should also be understood to include, as equivalents, derivatives, variants and analogs of either RNA or DNA made from nucleotide analogs, single (sense or antisense) and double-stranded polynucleotides. Deoxyribonucleotides include deoxyadenosine, deoxycytidine, deoxyguanosine and deoxythymidine. For RNA, the uracil base is uridine.

As used herein, "mass spectrometry" encompasses any suitable mass spectrometric format known to those of skill in the art. Such formats include, but are not limited to, Matrix-Assisted Laser Desorption/Ionization, Time-of-Flight (MALDI-TOF), Electrospray (ES), IR-MALDI (see, e.g., published International PCT Application No. WO 99/57318 and U.S. Pat. No. 5,118,937) Ion Cyclotron Resonance (ICR), Fourier Transform and combinations thereof. MALDI, particular UV and IR, are among the preferred formats.

As used herein, "at a position corresponding to" refers to a position of interest (i.e., base number or residue number) in a nucleic acid molecule or protein relative to the position in another reference nucleic acid molecule or protein. Corresponding positions can be determined by comparing and aligning sequences to maximize the number of matching nucleotides or residues, for example, such that identity between the sequences is greater than 95%, preferably greater than 96%, more preferably greater than 97%, even more preferably greater than 98% and most preferably greater than 99%. The position of interest is then given the number assigned in the reference nucleic acid molecule. For example, it is shown herein that a particular polymorphism in AKAP-10 occurs at nucleotide 2073 of SEQ ID No. 1. To identify the corresponding nucleotide in another allele or isolate, the sequences are aligned and then the position that lines up with 2073 is identified. Since various alleles may be of different length, the position designate 2073 may not be nucleotide 2073, but instead is at a position that "corresponds" to the position in the reference sequence.

As used herein, "primer" and "probe" refer to a nucleic acid molecule including DNA, RNA and analogs thereof, including protein nucleic acids (PNA), and mixtures thereof. Such molecules are typically of a length such that they are statistically unique (i.e., occur only once) in the genome of interest. Generally, for a probe or primer to be unique in the human genome, it contains at least 14, 16 or contiguous nucleotides of a sequence complementary to or identical to a gene of interest. Probes and primers can be 10, 20, 30, 50, 100 or more nucleic acids long.

As used herein, "antisense nucleic acid molecule" refers to a molecule encoding a sequence complementary to at least a portion of an RNA molecule. The sequence is sufficiently complementary to be able to hybridize with the RNA, preferably under moderate or high stringency conditions to form a stable duplex. The ability to hybridize depends on the degree of complementarity and the length of the antisense nucleic acid. Generally, the longer the hybridizing nucleic acid, the more base mismatches with an RNA it can contain and still form a stable duplex. One skilled in the art can ascertain a tolerable degree of mismatch by use of standard procedures to determine the melting point of the hybridized complex.

As used herein, a "variant protein" refers to a protein encoded by an allelic variant of a AKAP10 gene which results in a change of an amino acid residue at a particular position relative to that position in the protein encoded by the predominant allele.

As used herein, "signal transduction" refers to the propagation of a signal. In general, an extracellular signal is transmitted through the cell membrane to become an intracellular signal. This signal can then stimulate a cellular response. The term also encompasses signals that are propagated entirely within a cell. The polypeptide molecules involved in signal transduction processes are typically receptor and non-receptor protein kinases, receptor and non-receptor protein phosphatases, nucleotide exchange factors and transcription factors. One of the key biochemical mechanisms involved in signal transduction is protein phosphorylation. AKAP10 proteins are involved in signal transduction as they bind to protein kinase A (PKA) and are thought to anchor the kinase at a location, e.g., the mitochondria, where PKA acts to phosphorylate a specific substrate. Thus, an alteration in AKAP10 binding to PKA, localization to the mitochondria, or phosphorylation by PKA, among other steps will result in an alteration in signal transduction. Assays including those that determine phosphorylation by PKA, association of PKA and AKAP10 and localization of AKAP10 can be used to monitor the state of signal transduction.

As used herein, "adjacent" refers to a position 5' to the site of a single nucleotide polymorphism (SNP) such that there could be unpaired nucleotides between that position and the site of the SNP.

As used herein, "immediately adjacent" refers to a position 5' to the site of a single nucleotide polymorphism (SNP) such that there are no unpaired nucleotides between that position and the site of the SNP.

As used herein, "binding to PKA", refers to the interaction of the PKA binding domain of an AKAP10 protein and the regulatory subunits RI and/or RII of the protein kinase A holoenzyme.

B. Polymorphic AKAPs

Polymorphic sequences of A-kinase anchoring protein (AKAP) genes are provided herein. Also provided herein are polymorphic AKAP proteins encoded by polymorphic AKAP gene sequences. These polymorphic sequences are based on differences discovered in AKAP genes within and among different organisms, and, in particular, humans.

Polymorphisms of the genome can lead to altered gene function, protein function or mRNA instability. AKAPs provide a mechanism for regulating ubiquitous cAMP-dependent kinase (PKA) activity by tethering PKA to specific subcellular locations thereby segregating it with particular components in a given signaling pathway and contributing to specificity in cellular responses to extracellular signals. AKAPs thus play a fundamental role in the basic functioning of cells, the response of cells to their environment and ultimately in the coordination of vital systems within an organism. Therefore, polymorphisms in AKAP gene sequences may significantly affect the proper functioning of cells and systems within organisms and could be directly linked with certain disorders or could predispose an organism to a variety of diseases and disorders, especially those involving alterations in cellular protein phosphorylation and/or signal transduction. Among such disorders and diseases are: neurodegenerative diseases, such as Alzheimer's Disease, cardiovascular disorders, cardiac disorders, particularly disorders associated with altered left ventricular function, cardiomyopathies, proliferative disorders, bipolar disorder and other neurological disorders, obesity, diabetes and certain peripheral retinopathies, such as retinitis pigmentosa. The discovery of AKAP gene polymorphisms, such as those described herein, provides for the identification and development of diagnostic and prognostic methods, also provided herein, and the development of drug therapies and treatment regimens. Furthermore, polymorphisms of AKAP genes aid in the study of AKAP protein structure and function, which also contributes to the development of diagnostic methods and therapies.

1. AKAP10

The AKAP10 protein is primarily located in mitochondria. The sequence of a human AKAP10 cDNA (also referred to as D-AKAP2) is available in the GenBank database, at accession numbers AF037439 and NM 007202, and is provided in SEQ. ID. NO:1. The AKAP10 gene is located on chromosome 17.

The sequence of a mouse D-AKAP2 cDNA is also available in the GenBank database (see accession number AF021833). The mouse D-AKAP2 protein contains an RGS domain near the amino terminus that is characteristic of proteins that interact with Gα subunits and possess GTPase activating protein-like activity (Huang et al. (1997) *Proc. Natl. Acad. Sci. U.S.A.* 94:11184–11189). The human AKAP10 protein also has sequences homologous to RGS domains. The carboxy-terminal 40 residues of the mouse D-AKAP2 protein are responsible for the interaction with the regulatory subunits of PKA. This sequence is fairly well conserved between the mouse D-AKAP2 and human AKAP10 proteins.

2. Polymorphisms of the Human AKAP10 Gene and Polymorphic AKAP10 Proteins

Polymorphisms of AKAP genes that alter gene expression, regulation, protein structure and/or protein function are more likely to have a significant effect on the regulation of enzyme (particularly PKA) activity, cellular transduction of signals and responses thereto and on the basic functioning of cells than polymorphisms that do not alter gene and/or protein function. Included in the polymorphic AKAPs provided herein are human AKAP10 proteins containing differing amino acid residues at position number 646 of SEQ. ID. No. 2.

Amino acid 646 of the human AKAP10 protein (SEQ. ID. NO: 2) is located in the carboxy-terminal region of the protein within a segment that participates in the binding of R-subunits of PKAs. This segment includes the carboxy-terminal 40 amino acids.

The amino acid residue reported for position 646 of the human AKAP10 protein is an isoleucine. Polymorphic human AKAP10 proteins provided herein have the amino acid sequence set forth in SEQ. ID. NO: 2 but contain residues other than isoleucine at amino acid position 646 of the protein. In particular embodiments of the polymorphic human AKAP10 proteins provided herein, the amino acid at position 646 of SEQ. ID. NO: 2 is a valine (as set forth in SEQ. ID. NO: 4), leucine or phenylalanine residue.

a. An A to G Transition at Nucleotide 2073 of the Human AKAP10 Coding Sequence

As described herein, an allelic variant of the human AKAP10 gene is at the polymorphic site at position 2073 of the coding sequence (see SEQ.ID. NO: 3) and encodes a valine at position 646 of the AKAP10 protein. This allelic variant has been found to vary in frequency in DNA samples from younger and older segments of a healthy population. This allele has the A at position 2073 of the AKAP10 gene coding sequence of SEQ. ID. NO: 1 changed to a G, giving rise to the sequence set forth in SEQ. ID. NO: 3. Consequently, the codon for amino acid 646 changes from ATT, coding for isoleucine, to GTT, coding for valine.

b. An A to C Transversion at Nucleotide 2073 of the Human AKAP10 Coding Sequence In another human AKAP10 allelic variant, the nucleotide at position 2073 of the coding sequence in SEQ. ID. NO: 1 is changed from an A to a C. Thus, changing the codon for amino acid 646 from ATT, coding for isoleucine, to CTT, coding for leucine.

c. An A to T Transversion at Nucleotide 2073 of the Human AKAP10 Coding Sequence In another human AKAP10 allelic variant, the nucleotide at position 2073 of the coding sequence in SEQ. ID. NO: 1 is changed from an A to a T. Thus, the codon for amino acid 646 changes from ATT, coding for isoleucine, to TTT, coding for phenylalanine.

d. Other AKAP10 Polymorphisms

TABLE 3

| Name | GenBank Accession No. | SNP | Location |
|------|----------------------|-----|----------|
| 10-1 | AC005730 | T/C | 156277 |
| 10-6 | AC005730 | C/G | 83587 |
| 10-7 | AC005730 | G/A | 129600 |

For AKAP10-1 additional variants are represented by the presence of A or G at nucleotide position 156277 of SEQ ID NO: 17.

For AKAP10-6 additional variants are represented by the presence of A or T at nucleotide position 83587 of SEQ ID NO: 17.

For AKAP10-7 additional variants are represented by the presence of C or T at nucleotide position 129600 of SEQ ID NO: 17.

C. Isolation of Polymorphic AKAP10 Gene Sequences

Exemplary nucleic acid sequences encoding polymorphic human AKAP10 proteins are represented by nucleotides which encode the amino acid sequence as set forth in SEQ. ID. NO: 3. Nucleotide sequences encoding the amino acid sequence as set forth in SEQ. ID. NO: 1 in which amino acid 646 has been replaced with a leucine or phenylalanine are also provided herein.

Other exemplary nucleic acid sequences represent allelic variants of the AKAP10 gene which are not located in protein coding regions. Such as set forth in nucleotide position 83,580 to position 156,577 of SEQ ID NO: 13, 14 and 18.

Nucleic acid encoding polymorphic human AKAP10 proteins and genes provided herein may be isolated by screening suitable human cDNA or human genomic libraries under suitable hybridization conditions with nucleic acids such as those provided in SEQ. ID. NOS: 1, 3, 13, 14, 17 and 18. Suitable libraries can be prepared from human tissue and cell samples. In order to isolate cDNA encoding a polymorphic human AKAP10 it is preferable to screen libraries prepared from different tissues as the allele may not be expressed in all tissues or at similar levels in different tissues. The library can be screened with a portion of DNA including substantially the entire human AKAP10 or polymorphic AKAP10 protein-encoding sequence as set forth in SEQ. ID. NOS. 1, 3, 13, 14, 17 and 18, or the library may be screened with a suitable probe.

After screening the library, positive clones are identified by detecting a hybridization signal; the identified clones are characterized by restriction enzyme mapping and/or DNA sequence analysis, and then examined, by comparison with the sequences set forth herein to ascertain whether they include DNA encoding a complete polymorphic human AKAP10 protein (i.e., if they include translation initiation and termination codons). If the selected clones are incomplete, they may be used to rescreen the same or a different library to obtain overlapping clones. If the library is genomic, then the overlapping clones may include exons and introns. If the library is a cDNA library, then the overlapping clones will include an open reading frame. In both instances, clones may be identified by comparison with the DNA and encoded proteins provided herein.

In an alternative method, oligonucleotides based on the human AKAP10 or polymorphic AKAP10 protein-encoding sequence as set forth in SEQ. ID. NOS. 1, 3, 13, 14, 17 and 18, may be used to amplify fragments of the protein coding region of the AKAP10 gene from human cDNA or genomic sequence.

The isolated nucleic acid sequences can be incorporated into vectors for further manipulation. As used herein, vector (or plasmid) refers to discrete elements that are used to introduce heterologous DNA into cells for either expression or replication thereof. Selection and use of such vehicles are well within the skill of the artisan.

D. Detection of Polymorphisms in Human AKAP10 Genes

Methods of determining the presence or absence of allelic variants of a human AKAP10 gene are also provided. In particular methods, the detection or identification of a G, C, or T nucleotide at position 2073 of the sense strand of the human AKAP10 gene coding sequence (see SEQ ID NO: 1), or the detection or identification of a C, G or A nucleotide at the same position in the antisense strand of the human AKAP10 gene coding sequence, indicates the presence of an allelic variant. In these particular methods, the detection or identification of an A nucleotide at position 2073 of the sense strand of the human AKAP10 gene coding sequence, or the detection or identification of a T nucleotide at the same position in the antisense strand of the human AKAP10 gene coding sequence, indicates the absence of polymorphism.

Other methods for determining the presence or absence of an allelic variant of the AKAP10 gene detect or identify a nucleotide other than a C at position 83587 of the SEQ ID NO: 17 or a nucleotide other than a G on the complementary strand, a nucleotide other than a G at position 129600 of the SEQ ID NO: 17 or a nucleotide other than a C on the complementary strand or a nucleotide other than T at position 156,277 of SEQ ID NO: 17 or a nucleotide other than A on the complementary strand.

1. Nucleic acid Detection Methods

Generally, these methods are based in sequence-specific polynucleotides, oligonucleotides, probes and primers. Any method known to those of skill in the art for detecting a specific nucleotide within a nucleic acid sequence or for determining the identity of a specific nucleotide in a nucleic acid sequence is applicable to the methods of determining the presence or absence of an allelic variant of the AKAP10 gene. Such methods include, but are not limited to, techniques utilizing nucleic acid hybridization of sequence-specific probes, nucleic acid sequencing, selective amplification, analysis of restriction enzyme digests of the nucleic acid, cleavage of mismatched heteroduplexes of nucleic acid and probe, alterations of electrophoretic mobility, primer specific extension, oligonucleotide ligation assay and single-stranded conformation polymorphism analysis. In particular, primer extension reactions that specifically terminate by incorporating a dideoxynucleotide are useful for detection. Several such general nucleic acid detection assays are known (see, e.g., U.S. Pat. No. 6,030,778).

a. Primer Extension-based Methods

Several primer extension-based methods for determining the identity of a particular nucleotide in a nucleic acid sequence have been reported (see, e.g., PCT Application Nos. PCT/US96/03651 (WO96/29431), PCT/US97/20444 (WO 98/20166), PCT/US97/20194 (WO 98/20019), PCT/US91/00046 (WO91/13075), and U.S. Pat. Nos. 5,547,835, 5,605,798, 5,622,824, 5,691,141, 5,872,003, 5,851,765, 5,856,092, 5,900,481, 6,043,031, 6,133,436 and 6,197,498.) In general, a primer is prepared that specifically hybridizes adjacent to a polymorphic site in a particular nucleic acid molecule. The primer is then extended in the presence of one or more dideoxynucleotides, typically with at least one of the dideoxynucleotides being the complement of the nucleotide that is polymorphic at the site. The primer and/or the dideoxynucleotides may be labeled to facilitate a determination of primer extension and identity of the extended nucleotide. In a preferred method, primer extension and/or the identity of the extended nucleotide(s) are determined by mass spectrometry (see, e.g., PCT Application Nos. PCT/US96/03651 (WO96/29431), PCT Application No. PCT/US97/20444 (WO 98/20166), PCT Application No. PCT/US97/20194 (WO 98/20019), PCT Application No. PCT/US91/00046 (WO91/13075), and U.S. Pat. Nos. 5,605,798, 5,622,824, 5,856,092.

b. Polymorphism-specific probe hybridization

A preferred detection method is allele specific hybridization using probes overlapping the polymorphic site and having about 5, 10, 15, 20, 25, or 30 nucleotides around the polymorphic region. The probes can contain naturally occurring or modified nucleotides (see U.S. Pat. No. 6,156,501). For example, oligonucleotide probes may be prepared in which the known polymorphic nucleotide is placed centrally (allele-specific probes) and then hybridized to target DNA under conditions which permit hybridization only if a perfect match is found (Saiki et al. (1986) Nature 324:163; Saiki et al. (1989) Proc. Natl Acad. Sci USA 86:6230; and Wallace et al. (1979) Nucl. Acids Res. 6:3543). Such allele specific oligonucleotide hybridization techniques may be used for the simultaneous detection of several nucleotide changes in different polymorphic regions. For example, oligonucleotides having nucleotide sequences of specific allelic variants are attached to a hybridizing membrane and this membrane is then hybridized with labeled sample nucleic acid. Analysis of the hybridization signal will then reveal the identity of the nucleotides of the sample nucleic acid. In a preferred embodiment, several probes capable of hybridizing specifically to allelic variants are attached to a solid phase support, e.g., a "chip". Oligonucleotides can be bound to a solid support by a variety of processes, including lithography. For example a chip can hold up to 250,000 oligonucleotides (GeneChip, Affymetrix, Santa Clara, Calif.). Mutation detection analysis using these chips comprising oligonucleotides, also termed "DNA probe arrays" is described e.g., in Cronin et al. (1996) Human Mutation 7:244 and in Kozal et al (1996) Nature Medicine 2:753. In one embodiment, a chip includes all the allelic variants of at least one polymorphic region of a gene. The solid phase support is then contacted with a test nucleic acid and hybridization to the specific probes is detected. Accordingly, the identity of numerous allelic variants of one or more genes can be identified in a simple hybridization experiment.

c. Nucleic Acid Amplification-based Methods

In other detection methods, it is necessary to first amplify at least a portion of an AKAP gene prior to identifying the allelic variant. Amplification can be performed, e.g., by PCR and/or LCR, according to methods known in the art. In one embodiment, genomic DNA of a cell is exposed to two PCR primers and amplification is performed for a number of cycles sufficient to produce the required amount of amplified DNA. In preferred embodiments, the primers are located between 150 and 350 base pairs apart.

Alternative amplification methods include: self sustained sequence replication (Guatelli, J. C. et al., 1990, Proc. Natl. Acad. Sci. U.S.A. 87:1874–1878), transcriptional amplification system (Kwoh, D. Y. et al., 1989, Proc. Natl. Acad. Sci. U.S.A. 86:1173–1177), Q-Beta Replicase (Lizardi, P. M. et al., 1988, Bio/Technology 6:1197), or any other nucleic acid amplification method, followed by the detection of the amplified molecules using techniques well known to those of skill in the art. These detection schemes are especially useful for the detection of nucleic acid molecules if such molecules are present in very low numbers.

Alternatively, allele specific amplification technology, which depends on selective PCR amplification may be used in conjunction with the alleles provided herein. Oligonucleotides used as primers for specific amplification may carry the allelic variant of interest in the center of the molecule (so that amplification depends on differential hybridization) (Gibbs et al. (1989) Nucleic Acids Res. 17:2437–2448) or at the extreme 3' end of one primer where, under appropriate conditions, mismatch can prevent, or reduce polymerase extension (Prossner (1993) Tibtech 11:238; Newton et al. (1989) Nucl. Acids Res. 17:2503). In addition it may be desirable to introduce a restriction site in the region of the mutation to create cleavage-based detection (Gasparini et al. (1992) Mol. Cell Probes 6:1).

d. Nucleic Acid Sequencing-based Methods

In one embodiment, any of a variety of sequencing reactions known in the art can be used to directly sequence at least a portion of an AKAP gene and to detect allelic variants, e.g., mutations, by comparing the sequence of the sample sequence with the corresponding wild-type (control) sequence. Exemplary sequencing reactions include those based on techniques developed by Maxam and Gilbert (Proc. Natl. Acad. Sci. USA (1977) 74:560) or Sanger (Sanger et al. (1977) Proc. Natl. Acad. Sci 74:5463). It is also contemplated that any of a variety of automated sequencing procedures may be used when performing the subject assays (Biotechniques (1995) 19:448), including sequencing by mass spectrometry (see, for example, U.S. Pat. Nos. 5,547,835, 5,691,141, and International PCT Application No. PCT/US94/00193 (WO 94/16101), entitled "DNA Sequencing by Mass Spectrometry" by H. Köster; U.S. Pat. Nos. 5,547,835, 5,622,824, 5,851,765, 5,872,003, 6,074,823, 6,140,053 and International PCT Application No. PCT/US94/02938 (WO 94/21822), entitled "DNA Sequencing by Mass Spectrometry Via Exonuclease Degradation" by H. Köster), and U.S. Pat. Nos. 5,605,798, 6,043,031, 6,197, 498, and International Patent Application No. PCT/US96/03651 (WO 96/29431) entitled "DNA Diagnostics Based on Mass Spectrometry" by H. Köster; Cohen et 8/. (1996) Adv Chromatogr 36:127–162; and Griffin et al. (1993) Appl Biochem Biotechnol 38:147–159). It will be evident to one skilled in the art that, for certain embodiments, the occurrence of only one, two or three of the nucleic acid bases need be determined in the sequencing reaction. For instance, A-track sequencing or an equivalent. e.g., where only one nucleotide is detected, can be carried out. Other sequencing methods are known (see, e.g., in U.S. Pat. No. 5,580,732 entitled "Method of DNA sequencing employing a mixed DNA-polymer chain probe" and U.S. Pat. No. 5,571,676 entitled "Method for mismatch-directed in vitro DNA sequencing").

e. Restriction Enzyme Digest Analysis

In some cases, the presence of a specific allele in nucleic acid, particularly DNA, from a subject can be shown by restriction enzyme analysis. For example, a specific nucleotide polymorphism can result in a nucleotide sequence containing a restriction site which is absent from the nucleotide sequence of another allelic variant.

f. Mismatch Cleavage

Protection from cleavage agents, such as, but not limited to, a nuclease, hydroxylamine or osmium tetroxide and with piperidine, can be used to detect mismatched bases in RNA/RNA DNA/DNA, or RNA/DNA heteroduplexes (Myers, et al. (1985) Science 230:1242). In general, the technique of "mismatch cleavage" starts by providing heteroduplexes formed by hybridizing a control nucleic acid, which is optionally labeled, e.g., RNA or DNA, comprising a nucleotide sequence of an allelic variant with a sample nucleic acid, e.g, RNA or DNA, obtained from a tissue sample. The double-stranded duplexes are treated with an agent, which cleaves single-stranded regions of the duplex such as duplexes formed based on basepair mismatches between the control and sample strands. For instance, RNA/DNA duplexes can be treated with RNase and DNA/DNA hybrids treated with S1 nuclease to enzymatically digest the mismatched regions.

In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine whether the control and sample nucleic acids have an identical nucleotide sequence or in which nucleotides they differ (see, for example, Cotton et al. (1988) Proc. Natl Acad Sci USA 85:4397; Saleeba et al. (1992) Methods Enzymod. 217:286–295). The control or sample nucleic acid is labeled for detection.

g. Electrophoretic Mobility Alterations

In other embodiments, alteration in electrophoretic mobility is used to identify the type of allelic variant in an AKAP gene. For example, single-strand conformation polymorphism (SSCP) may be used to detect differences in electrophoretic mobility between mutant and wild type nucleic acids (Orita et al. (1989) Proc. Natl. Acad. Sci. USA 86:2766, see also Cotton (1993) Mutat Res 285:125–144; and Hayashi (1992) Genet Anal Tech Appl 9:73–79). Single-stranded DNA fragments of sample and control nucleic acids are denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In another preferred embodiment, the subject method uses heteroduplex analysis to separate double stranded heteroduplex molecules on the basis of changes in electrophoretic mobility (Keen et al. (1991) Trends Genet 7:5).

h. Polyacrylamide Gel Electrophoresis

In yet another embodiment, the identity of an allelic variant of a polymorphic region of an AKAP gene is obtained by analyzing the movement of a nucleic acid comprising the polymorphic region in polyacrylamide gels containing a gradient of denaturant is assayed using denaturing gradient gel electrophoresis (DGGE) (Myers et al. (1985) Nature 313:495). When DGGE is used as the method of analysis, DNA will be modified to ensure that it does not completely denature, for example by adding a GC clamp of approximately 40 bp of high-melting GC-rich DNA by PCR. In a further embodiment, a temperature gradient is used in place of a denaturing agent gradient to identify differences in the mobility of control and sample DNA (Rosenbaum and Reissner (1987) Biophys Chem 265:1275).

i. Oligonucleotide Ligation Assay (OLA)

In another embodiment, identification of the allelic variant is carried out using an oligonucleotide ligation assay (OLA), as described, e.g., in U.S. Pat. No. 4,998,617 and in Landegren, U. et al., Science 241:1077–1080 (1988). The OLA protocol uses two oligonucleotides which are designed to be capable of hybridizing to abutting sequences of a single strand of a target. One of the oligonucleotides is linked to a separation marker, e.g,. biotinylated, and the other is detectably labeled. If the precise complementary sequence is found in a target molecule, the oligonucleotides will hybridize such that their termini abut, and create a ligation substrate. Ligation then permits the labeled oligonucleotide to be recovered using avidin, or another biotin ligand. Nickerson, D. A. et al. have described a nucleic acid detection assay that combines attributes of PCR and OLA (Nickerson, D. A. et al., Proc. Natl. Acad. Sci. (U.S.A.) 87:8923–8927 (1990). In this method, PCR is used to achieve the exponential amplification of target DNA, which is then detected using OLA.

Several techniques based on this OLA method have been developed and can be used to detect specific allelic variants of a polymorphic region of a gene. For example, U.S. Pat. No. 5,593,826 discloses an OLA using an oligonucleotide having 3'-amino group and a 5'-phosphorylated oligonucleotide to form a conjugate having a phosphoramidate linkage. In another variation of OLA described in Tobe et al. (1996) Nucl. Acids Res. 24: 3728), OLA combined with PCR permits typing of two alleles in a single microtiter well. By marking each of the allele-specific primers with a unique hapten, i.e. digoxigenin and fluorescein, each OLA reaction can be detected by using hapten specific antibodies that are labeled with different enzyme reporters, alkaline phosphatase or horseradish peroxidase. This system permits the detection of the two alleles using a high throughput format that leads to the production of two different colors.

j. SNP Detection Methods

Also provided are methods for detecting single nucleotide polymorphisms. Because single nucleotide polymorphisms constitute sites of variation flanked by regions of invariant sequence, their analysis requires no more than the determination of the identity of the single nucleotide present at the site of variation and it is unnecessary to determine a complete gene sequence for each patient. Several methods have been developed to facilitate the analysis of such single nucleotide polymorphisms.

In one embodiment, the single base polymorphism can be detected by using a specialized exonuclease-resistant nucleotide, as disclosed, e.g., in Mundy, C. R. (U.S. Pat. No. 4,656,127). According to the method, a primer complementary to the allelic sequence immediately 3' to the polymorphic site is permitted to hybridize to a target molecule obtained from a particular animal or human. If the polymorphic site on the target molecule contains a nucleotide that is complementary to the particular exonuclease-resistant nucleotide derivative present, then that derivative will be incorporated onto the end of the hybridized primer. Such incorporation renders the primer resistant to exonuclease, and thereby permits its detection. Since the identity of the exonuclease-resistant derivative of the sample is known, a finding that the primer has become resistant to exonucleases reveals that the nucleotide present in the polymorphic site of the target molecule was complementary to that of the nucleotide derivative used in the reaction. This method has the advantage that it does not require the determination of large amounts of extraneous sequence data.

In another embodiment, a solution-based method for determining the identity of the nucleotide of a polymorphic site is employed (Cohen, D. et al. (French Patent 2,650,840; PCT Application No. WO91/02087)). As in the Mundy method of U.S. Pat. No. 4,656,127, a primer is employed that is complementary to allelic sequences immediately 3' to a polymorphic site. The method determines the identity of the nucleotide of that site using labeled dideoxynucleotide derivatives, which, if complementary to the nucleotide of the polymorphic site will become incorporated onto the terminus of the primer.

k. Genetic Bit Analysis

An alternative method, known as Genetic Bit Analysis or GBA™ is described by Goelet, et al. (U.S. Pat. No. 6,004,744, PCT Application No. 92/15712). The method of Goelet, et al. uses mixtures of labeled terminators and a primer that is complementary to the sequence 3' to a polymorphic site. The labeled terminator that is incorporated is thus determined by, and complementary to, the nucleotide present in the polymorphic site of the target molecule being evaluated. In contrast to the method of Cohen et al. (French Patent 2,650,840; PCT Application No. WO91/02087), the method of Goelet, et al. is preferably a heterogeneous phase assay, in which the primer or the target molecule is immobilized to a solid phase.

l. Other Primer-guided Nucleotide Incorporation Procedures

Other primer-guided nucleotide incorporation procedures for assaying polymorphic sites in DNA have been described (Komher, J. S. et al., Nucl. Acids Res. 17:7779–7784 (1989); Sokolov, B. P., Nucl. Acids Res. 18:3671 (1990); Syvanen, A. C., et al., Genomics 8:684–692 (1990), Kuppuswamy, M. N. et al., Proc. Natl. Acad. Sci. (U.S.A.) 88:1143–1147 (1991); Prezant, T. R. et al., Hum. Mutat. 1:159–164 (1992); Ugozzoli, L. et al., GATA 9:107–112 (1992); Nyren, P. et al., Anal. Biochem. 208:171–175 (1993)). These methods differ from GBA™ in that they all rely on the incorporation of labeled deoxynucleotides to discriminate between bases at a polymorphic site. In such a format, since the signal is proportional to the number of deoxynucleotides incorporated, polymorphisms that occur in runs of the same nucleotide can result in signals that are proportional to the length of the run (Syvanen, A. C., et al., Amer. J. Hum. Genet. 52:46–59 (1993)).

For determining the identity of the allelic variant of a polymorphic region located in the coding region of a gene, yet other methods than those described above can be used. For example, identification of an allelic variant which encodes a mutated protein can be performed by using an antibody specifically recognizing the mutant protein in, e.g., immunohistochemistry or immunoprecipitation. Binding assays are known in the art and involve, e.g., obtaining cells from a subject, and performing binding experiments with a labeled lipid, to determine whether binding to the mutated form of the protein differs from binding to the wild-type protein.

m. Molecular Structure Determination

If a polymorphic region is located in an exon, either in a coding or non-coding region of the gene, the identity of the allelic variant can be determined by determining the molecular structure of the mRNA, pre-mRNA, or cDNA. The molecular structure can be determined using any of the above described methods for determining the molecular structure of the genomic DNA, e.g., sequencing and SSCP.

n. Mass Spectrometric Methods

Nucleic acids can also be analyzed by detection methods and protocols, particularly those that rely on mass spectrometry (see, e.g., U.S. Pat. Nos. 5,605,798, 6,043,031, 6,197,498, and International Patent Application No. WO 96/29431, allowed co-pending U.S. application Ser. No. 08/617,256, allowed co-pending U.S. application Ser. No. 08/744,481, U.S. application Ser. No. 08/990,851, International PCT Application No. WO 98/20019). These methods can be automated (see, e.g., co-pending U.S. application Ser. No. 09/285,481, which describes an automated process line). Preferred among the methods of analysis herein are those involving the primer oligo base extension (PROBE) reaction with mass spectrometry for detection (see e.g., U.S. Pat. Nos. 6,043,031 and 6,197,498, patent application Ser. Nos. 09/287,681, 09/287,682, and 09/287,679, allowed co-pending U.S. application Ser. No. 08/744,481, International PCT Application No. PCT/US97/20444 (WO 98/20166), and based upon U.S. Pat. Nos. 5,900,481, 6,024,925, 6,074,823, application Ser. Nos. 08/746,055, 08/786,988, 08/933,792, 08/746,055, and 08/786,988; see, also U.S. application Ser. No. 09/074,936, and published International PCT Application No. PCT/US97/20195 (WO 98/20020)).

A preferred format for performing the analyses is a chip based format in which the biopolymer is linked to a solid support, such as a silicon or silicon-coated substrate, preferably in the form of an array. More preferably, when analyses are performed using mass spectrometry, particularly MALDI, nanoliter volumes of sample are loaded on, such that the resulting spot is about, or smaller than, the size of the laser spot. It has been found that when this is achieved, the results from the mass spectrometric analysis are quantitative. The area under the peaks in the resulting mass spectra are proportional to concentration (when normalized and corrected for background). Methods for preparing and using such chips are described in U.S. Pat. No. 6,024,925, co-pending U.S. application Ser. Nos. 08/786,988, 09/364,774, 09/371,150 and 09/297,575; see, also PCT Application No. PCT/US97/20195 (WO 98/20020). Chips and kits for performing these analyses are commercially available from SEQUENOM under the trademark MassARRAY™. MassARRAY™ relies on the fidelity of the enzymatic primer extension reactions combined with the miniaturized array and MALDI-TOF (Matrix-Assisted Laser Desorption Ionization-Time of Flight) mass spectrometry to deliver results rapidly. It accurately distinguishes single base changes in the size of DNA fragments relating to genetic variants without tags.

Multiplex methods allow for the simultaneous detection of more than one polymorphic region in a particular gene. This is the preferred method for carrying out haplotype analysis of allelic variants of the AKAP10 gene.

Multiplexing can be achieved by several different methodologies. For example, several mutations can be simultaneously detected on one target sequence by employing corresponding detector (probe) molecules (e.g., oligonucleotides or oligonucleotide mimetics). The molecular weight differences between the detector oligonucleotides must be large enough so that simultaneous detection (multiplexing) is possible. This can be achieved either by the sequence itself (composition or length) or by the introduction of mass-modifying functionalities into the detector oligonucleotides (see below).

Mass modifying moieties can be attached, for instance, to either the 5'-end of the oligonucleotide, to the nucleobase (or bases), to the phosphate backbone, and to the 2'-position of the nucleoside (nucleosides) and/or to the terminal 3'-position. Examples of mass modifying moieties include, for example, a halogen, an azido, or of the type, XR, wherein X is a linking group and R is a mass-modifying functionality. The mass-modifying functionality can thus be used to introduce defined mass increments into the oligonucleotide molecule.

The mass-modifying functionality can be located at different positions within the nucleotide moiety (see, e.g., U.S. Pat. No. 5,547,835 and International PCT Application No. WO 94/21822). For example, the mass-modifying moiety, M, can be attached either to the nucleobase, (in case of the $c^7$-deazanucleosides also to C-7), to the triphosphate group at the alpha phosphate or to the 2'-position of the sugar ring of the nucleoside triphosphate. Modifications introduced at the phosphodiester bond, such as with alpha-thio nucleoside triphosphates, have the advantage that these modifications do not interfere with accurate Watson-Crick base-pairing and additionally allow for the one-step post-synthetic site-specific modification of the complete nucleic acid molecule e.g., via alkylation reactions (see, e.g., Nakamaye et al. (1988) Nucl. Acids Res. 16:9947–59). Particularly preferred mass-modifying functionalities are boron-modified nucleic acids since they are better incorporated into nucleic acids by polymerases (see, e.g., Porter et al. (1995) Biochemistry 34:11963–11969; Hasan et al. (1996) Nucleic Acids Res. 24:2150–2157; Li et al. (1995) Nucl. Acids Res. 23:4495–4501).

Furthermore, the mass-modifying functionality can be added so as to affect chain termination, such as by attaching it to the 3'-position of the sugar ring in the nucleoside triphosphate. For those skilled in the art, it is clear that many combinations can be used in the methods provided herein. In the same way, those skilled in the art will recognize that chain-elongating nucleoside triphosphates can also be mass-modified in a similar fashion with numerous variations and combinations in functionality and attachment positions.

For example, without being bound to any particular theory, the mass-modification can be introduced for X in XR as well as using oligo-/polyethylene glycol derivatives for R. The mass-modifying increment (m) in this case is 44, i.e. five different mass-modified species can be generated by just changing m from 0 to 4 thus adding mass units of 45 (m=0), 89 (m=1), 133 (m=2), 177 (m=3) and 221 (m=4) to the nucleic acid molecule (e.g., detector oligonucleotide (D) or the nucleoside triphosphates, respectively). The oligo/polyethylene glycols can also be monoalkylated by a lower alkyl such as, but are not limited to, methyl, ethyl, propyl, isopropyl and t-butyl. Other chemistries can be used in the mass-modified compounds (see, e.g., those described in Oligonucleotides and Analogues, A Practical Approach, F. Eckstein, editor, IRL Press, Oxford, 1991).

In yet another embodiment, various mass-modifying functionalities, R, other than oligo/polyethylene glycols, can be selected and attached via appropriate linking chemistries, X. A simple mass-modification can be achieved by substituting H for halogens, such as F, Cl, Br and/or I, or pseudohalogens such as CN, SCN, NCS, or by using different alkyl, aryl or aralkyl moieties such as methyl, ethyl, propyl, isopropyl, t-butyl, hexyl, phenyl, substituted phenyl, benzyl, or functional groups such as $CH_2F$, $CHF_2$, $CF_3$, $Si(CH_3)_3$, $Si(CH_3)_2(C_2H_5)$, $Si(CH_3)(C_2H_5)_2$, $Si(C_2H_5)_3$. Yet another mass-modification can be obtained by attaching homo- or heteropeptides through the nucleic acid molecule (e.g., detector (D)) or nucleoside triphosphates). One example, useful in generating mass-modified species with a mass increment of 57, is the attachment of oligoglycines (m) to nucleic acid molecules (r), e.g., mass-modifications of 74 (r=1, m=0), 131 (r=1, m=1), 188 (r=1, m=2), 245 (r=1, m=3) are achieved. Simple oligoamides also can be used, e.g., mass-modifications of 74 (r=1, m=0), 88 (r=2, m=0), 102 (r=3, m=0), 116(r=4, m=0), etc. are obtainable. Variations in additions to those set forth herein will be apparent to the skilled artisan.

Different mass-modified detector oligonucleotides can be used to simultaneously detect all possible variants/mutants simultaneously. Alternatively, all four base permutations at the site of a mutation can be detected by designing and positioning a detector oligonucleotide, so that it serves as a primer for a DNA/RNA polymerase with varying combinations of elongating and terminating nucleoside triphosphates. For example, mass modifications also can be incorporated during the amplification process.

A different multiplex detection format is one in which differentiation is accomplished by employing different specific capture sequences which are position-specifically immobilized on a flat surface (e.g., a 'chip array'). If different target sequences T1–Tn are present, their target capture sites TCS1–TCSn will specifically interact with complementary immobilized capture sequences C1–Cn. Detection is achieved by employing appropriately mass differentiated detector oligonucleotides D1–Dn, which are mass modifying functionalities M1–Mn.

o. Other Methods

Additional methods of analyzing nucleic acids include amplification-based methods including polymerase chain reaction (PCR), ligase chain reaction (LCR), mini-PCR, rolling circle amplification, autocatalytic methods, such as those using QJ replicase, TAS, 3SR, and any other suitable method known to those of skill in the art.

Other methods for analysis and identification and detection of polymorphisms, include but are not limited to, allele specific probes, Southern analyses, and other such analyses.

2. Primers, Probes and Antisense Nucleic Acid Molecules

Primers refer to nucleic acids which are capable of specifically hybridizing to a nucleic acid sequence which is adjacent to a polymorphic region of interest or to a polymorphic region and are extended. A primer can be used alone in a detection method, or a primer can be used together with at least one other primer or probe in a detection method. Primers can also be used to amplify at least a portion of a nucleic acid. For amplifying at least a portion of a nucleic acid, a forward primer (i.e., 5' primer) and a reverse primer (i.e., 3' primer) will preferably be used. Forward and reverse primers hybridize to complementary stands of a double stranded nucleic acid, such that upon extension from each primer, a double stranded nucleic acid is amplified.

Probes refer to nucleic acids which hybridize to the region of interest and which are not further extended. For example, a probe is a nucleic acid which hybridizes adjacent to or at a polymorphic region of an AKAP gene and which by hybridization or absence of hybridization to the DNA of a subject will be indicative of the identity of the allelic variant of the polymorphic region of the gene. Preferred probes have a number of nucleotides sufficient to allow specific hybridization to the target nucleotide sequence. Where the target nucleotide sequence is present in a large fragment of DNA, such as a genomic DNA fragment of several tens or hundreds of kilobases, the size of a probe may have to be longer to provide sufficiently specific hybridization, as compared to a probe which is used to detect a target sequence which is present in a shorter fragment of DNA. For example, in some diagnostic methods, a portion of an AKAP gene may first be amplified and thus isolated from the rest of the chromosomal DNA and then hybridized to a probe. In such a situation, a shorter probe will likely provide sufficient specificity of hybridization. For example, a probe having a nucleotide sequence of about 10 nucleotides may be sufficient.

Primers and probes (RNA, DNA (single-stranded or double-stranded), PNA and their analogs) described herein may be labeled with any detectable reporter or signal moiety including, but not limited to radioisotopes, enzymes, antigens, antibodies, spectrophotometric reagents, chemiluminescent reagents, fluorescent and any other light producing chemicals. Additionally, these probes may be modified without changing the substance of their purpose by terminal addition of nucleotides designed to incorporate restriction sites or other useful sequences, proteins, signal generating ligands such as acridinium esters, and/or paramagnetic particles.

These probes may also be modified by the addition of a capture moiety (including, but not limited to para-magnetic particles, biotin, fluorescein, dioxigenin, antigens, antibodies) or attached to the walls of microtiter trays to assist in the solid phase capture and purification of these probes and any DNA or RNA hybridized to these probes. Fluorescein may be used as a signal moiety as well as a capture moiety, the latter by interacting with an anti-fluorescein antibody.

Any probe, primer or antisense molecule can be prepared according to methods well known in the art and described, e.g., in Sambrook, J. Fritsch, E. F., and Maniatis, T. (1989 (Molecular Cloning: A Laboratory Manual, Cold Spring Harbor Laboratory Press, Cold Spring Harbor, N.Y. For example, discrete fragments of the DNA can be prepared and cloned using restriction enzymes. Alternatively, probes and primers can be prepared using the Polymerase Chain Reaction (PCR) using primers having an appropriate sequence.

Oligonucleotides may be synthesized by standard methods known in the art, e.g. by use of an automated DNA synthesizer (such as are commercially available from Biosearch (Novato, Calif.); Applied Biosystems (Foster City, Calif.) and other methods). As examples, phosphorothioate oligonucleotides may be synthesized by the method of Stein et al. (1988, Nucl. Acids Res. 16:3209), methylphosphonate oligonucleotides, for example, can be prepared by use of controlled pore glass polymer supports (Sarin et al., 1988, Proc. Natl. Acad. Sci. U.S.A. 85:7448–7451).

Probes and primers used in the methods of detecting allelic variants in human AKAP10 genes are of sufficient length to specifically hybridize to portions of AKAP10 gene at polymorphic sites. Typically such lengths depend upon the complexity of the source organism genome. For humans such lengths are at least 14–16 nucleotides, and typically may be 20, 30, 50, 100 or more nucleotides.

The methods of detecting polymorphisms in human AKAP10 genes provided herein, probes and primers include the following:

(1) at least 14 or 16 contiguous nucleotides of the AKAP10 allele or complement thereof, wherein nucleic acid molecule includes at least 5 contiguous nucleotides from nucleotide 2069 to nucleotide 2077 of SEQ. ID. NO: 3;

(2) at least 14 or 16 contiguous nucleotides of the AKAP10 allele or complement thereof, wherein the nucleic acid includes the nucleotide at position 2073 of SEQ ID No. 1 replaced with G, C or T.

(3) at least 14 or 16 contiguous nucleotides of the AKAP10 allele or complement thereof, wherein the nucleic acid molecule includes at least 5 contiguous nucleotides from nucleotide 129556 to nucleotide 129604 of SEQ. ID. NO: 14;

(4) at least 14 or 16 contiguous nucleotides of the AKAP10 allele or complement thereof, wherein the nucleic acid includes the nucleotide at position 129600 of SEQ ID No. 17 replaced with A, C or T;

(5) at least 14 or 16 contiguous nucleotides of the AKAP10 allele or complement thereof, wherein the nucleic acid molecule includes at least 5 contiguous nucleotides from nucleotide 83583 to nucleotide 83591 of SEQ. ID. NO: 13;

(6) at least 14 or 16 contiguous nucleotides of the AKAP10 allele or complement thereof, wherein the nucleic acid includes the nucleotide at position 83587 of SEQ ID No. 17 replaced with G, A or T;

(7) at least 14 or 16 contiguous nucleotides of the AKAP10 allele or complement thereof, wherein the nucleic acid molecule includes at least 5 contiguous nucleotides from nucleotide 156,273 to nucleotide 156281 of SEQ. ID. NO: 18;

(8) at least 14 or 16 contiguous nucleotides of the AKAP10 allele or complement thereof, wherein the nucleic acid includes the nucleotide at position 156277 of SEQ ID No. 17 replaced with C, A or G;

With respect to each of the above described probes and primers, they have fewer nucleotides than the sequence of nucleotides 138 to 2126 of SEQ. ID. NO: 1 or fewer nucleotides than the sequence of nucleotides 83,580 to 156,577 of SEQ ID NO: 17.

Antisense compounds may be conveniently and routinely made through the well-known techniques of solid phase synthesis. Equipment for such synthesis is sold by several vendors including, for example, Applied Biosystems (Foster City, Calif.). Any other means for such synthesis known in the art may additionally or alternatively be employed. It is well known to use similar techniques to prepare oligonucleotides such as the phosphorothioates and alkylated derivatives.

Antisense compounds are typically 8 to 30 nucleotides in length, are complementary to a targeted nucleic acid molecule and modulate its expression. The targeted nucleic acid molecule represents the coding strand. For example, for the AKAP10-5 allelic variant, an antisense compound is an antisense oligonucleotide that comprises the complement of at least an 8 nucleotide segment of SEQ ID NO: 3 including the nucleotide at position 2073 of SEQ ID NO: 3.

An antisense compound can contain at least one modified nucleotide that can confer nuclease resistance or increase the binding of the antisense compound with the target nucleotide. The antisense compound can contain at least one internucleoside linkage wherein the modified internucleoside linkage of the antisense oligonucleotide can be a phosphorothioate linkage, a morpholino linkage or a peptide-nucleic acid linkage.

Preferred modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative United States patents that teach the preparation of the above oligonucleosides include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

An antisense compound can contain at least one modified sugar moiety wherein the modified sugar moiety of the antisense oligonucleotide is a 2'-O-methoxyethyl sugar moiety or a 2'-dimethylaminooxyethoxy sugar moiety.

Modified oligonucleotides may also contain one or more substituted sugar moieties. Preferred oligonucleotides comprise one of the following at the 2' position: OH; F; O—, S—, or N-alkyl; O—, S—, or N-alkenyl; O—, S— or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly preferred are $O[(CH_2)_nO]_mCH_3$, $O(CH_2)_nOCH_3$, $O(CH_2)_nNH_2$, $O(CH_2)_nCH_3$, $O(CH_2)_nNH_2$, and $O(CH_2)_nON[(CH_2)_nCH_3)]_2$, where n and m are from 1 to about 10. Other preferred oligonucleotides comprise one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A preferred modification includes an alkoxyalkoxy group, 2'-methoxyethoxy (2'-O—$CH_2CH_2OCH_3$, also known as 2'-O- (2-methoxyethyl) or 2'-MOE) (Martin et al., Helv. Chim. Acta, 1995, 78, 486–504). A further preferred modification includes 2'-dimethylaminooxyethoxy, i.e., a $O(CH_2)_2$ $ON(CH_3)_2$ group, also known as 2'-DMAOE.

Other preferred modifications include 2'-methoxy (2'-O—$CH_3$), 2'-aminopropoxy (2'-$OCH_2CH_2CH_2NH_2$) and 2'-fluoro (2'-F). Similar modifications may also be made at other positions on the oligonucleotide, particularly the 3' position of the sugar on the 3' terminal nucleotide or in 2'-5' linked oligonucleotides and the 5' position of 5' terminal nucleotide. Oligonucleotides may also have sugar mimetics such as cyclobutyl moieties in place of the pentofuranosyl sugar. Representative United States patents that teach the reparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,0531 5,639,873; 5,646,265; 5,658,873; 5,670,633; and 5,700,920, each of which is herein incorporated by reference.

An antisense compound can contain at least one modified nucleobase. Oligonucleotides may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine.

Further nucleobases include those disclosed in U.S. Pat. No. 3,687,808, those disclosed in The Concise Encyclopedia Of Polymer Science And Engineering, pages 858–859, Kroschwitz, J. I., ed. John Wiley & Sons, 1990, those disclosed by Englisch et al., Angewandte Chemie, International Edition, 1991, 30, 613, and those disclosed by Sanghvi, Y. S., Crooke, S. T., and Lebleu, B. eds., Antisense Research and Applications, CRC Press, Boca Raton, 1993, pp. 289–302. Certain of these nucleobases are particularly useful for increasing the binding affinity of the oligomeric compounds of the invention. These include 5-substituted pyrimidines, 6-azapyrimidines and N-2, N-6 and O-6 substituted purines, including 2-aminopropyl-adenine, 5-propynyluracil and 5-propynylcytosine. 5-methylcytosine substitutions have been shown to increase nucleic acid duplex stability by 0.6–1.2.degree. C. (Sanghvi, Y. S., Crooke, S. T. and Lebleu, B., eds., Antisense Research and Applications, CRC Press, Boca Raton, 1993, pp. 276–278) and are presently preferred base substitutions, even more particularly when combined with 2'-O-methoxyethyl sugar modifications.

The antisense compound can be a chimeric oligonucleotide. Chimeric antisense compounds may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures include, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

E. Association of AKAP10 Allelic Variants with Morbidity or Increased Mortality

Polymorphisms of the genome can lead to altered gene function, protein function or mRNA instability. To identify those polymorphisms that have clinical relevance is the goal of a world-wide scientific effort. Discovery of such polymorphisms will have a fundamental impact on the identification and development of diagnostics and drug discovery. The strategy to identify valuable polymorphisms is cumbersome and dependent upon the availability of many large patient and control cohorts to show disease association. Furthermore, genes, and their associated polymorphisms, that cause a general risk of the population to suffer from any disease will escape these case/control studies entirely.

A morbidity susceptibility gene could be a gene that is expressed in many different cell types or tissues (housekeeping gene) and its altered function can facilitate the expression of a clinical phenotype caused by a disease-specific susceptibility gene that is involved in a pathway specific for this disorder. In other words, morbidity susceptibility genes might predispose people to develop a distinct disease according to their genetic make-up for this disease. Candidates for these genes may involve basic cellular processes such as: transcription, translation, heat-shock proteins, protein trafficking, DNA repair, assembly systems for subcellular structures (e.g., mitochondria, peroxysomes and other cellular microbodies), receptor signaling cascades, immunology, etc. Those pathways control the quality of life at the cellular level as well as for the entire organism. Mutations/polymorphisms located in genes encoding proteins for those pathways can reduce the fitness of cells and make the organism more susceptible to express the clinical phenotype caused by the action of a disease-specific susceptibility gene. Therefore, these morbidity susceptibility genes can be potentially involved in a whole variety of different complex diseases if not in all.

An example of possible candidate morbidity susceptibility genes are mutants of the A kinase anchoring protein (AKAP) genes. Protein phosphorylation is an important mechanism for enzyme regulation and signal transduction in eukaryotic cells. cAMP dependent protein kinase (PKA) mediates a variety of hormonal and neurotransmitter responses by phosphorylating a wide variety of substrates including enzymes, membrane receptors, ion channels and transcription factors. AKAPs direct the subcellular localization of cAMP-dependent protein kinase by binding to its regulatory subunits and therefore plays a role in G-protein mediated receptor-signalling pathways. (Huang et al. Proc. Natl. Acad. Sci., USA 94:11184, 1997). AKAPs have a PKA binding region located in their COOH-terminal portion.

Polymorphic AKAP genes, such as those provided herein, serve as markers for detecting predisposition to disease and various conditions. Also, the AKAP alleles and gene products, especially the AKAP-10-5 gene product should be suitable pharmaceutical targets and gene therapy targets.

F. Databases

Use of databases containing sets of parameters associated with subjects in populations selected on the basis of apparent good health, not manifesting detectable disease (i.e., an unbiased population not selected for any disease state), allows for identification of such morbidity susceptibility genes (see, U.S. Provisional Application Serial No. 60/159,176 filed Oct. 13, 1999, U.S. Provisional Application Ser. No. 60/217,658 filed on Jul. 10, 2000 and U.S. application Ser. No. 09/687,483 filed Oct. 13, 2000).

For example, in a method for determining susceptibility to morbidity, increased or early mortality, or morbidity and increased or early mortality in a human being, provided herein, exemplary steps include detecting the presence or absence of an allele of the human AKAP-10 containing other than an A at position 2073 of the coding sequence of the AKAP-10 gene; wherein the presence of an allele containing other than an A at position 2073 is indicative of increased susceptibility to morbidity, increased or early mortality, or morbidity and increased or early mortality as compared to the susceptibility of a human being who does not comprise an allele containing other than an A at position 2073 of the AKAP-10 gene coding sequence. 1. Correlation of an AKAP10 SNP with Family History of Heart Disease As noted above, using a healthy patient database (see, U.S. Provisional Application Ser. No. 60/159,176 and U.S. Provisional Application Ser. No. 60/217,658 and U.S. application Ser. No. 09/687,483 filed Oct. 13, 2000), the frequency of occurrence of the AKAP10-5 SNP in such a population was found to decrease with age, thus making the allele a potential morbidity susceptibility gene, a gene associated with increased mortality or both. Using the healthy database, it was found that the homozygote GG genotype drops in the elderly population (over >60 years) by a statistically significant amount, p 32 0.02.

The healthy database was then stratified (i.e., sorted) by information given by the donors about common disorders from which their parents suffered (the donor's familial history of disease). The study found that, in males 50 years and older, the AKAP10-5 allele is associated with cardiovascular disease. The subpopulation of donors 50 years and older was used in the study to insure that the parents were old enough to have potentially manifested the disease.

The frequency of the heterozygous genotype (A/G; ILE/VAL) showed an increase between none affected, one affected and both affected groups. For a disease that showed no correlation, there was no difference among these groups.
2. Correlation of an AKAP10 SNP with Altered Left Ventricular Function The frequency of the AKAP10-5 SNP in DNA samples isolated from the blood of patients diagnosed with either coronary artery disease (CAD) or abnormal left ventricular (LV) function was investigated. These disorders were diagnosed in the patient population by cardiac catheterization. The left ventricle is the most important of the four chambers in the heart because it generates the pressure needed to circulate blood throughout the body. In addition, poor function of the left ventricle can be the indirect cause of other problems such as certain abnormal heart rhythms and stroke.

The AKAP allele frequencies in the initial set of patient DNAs (145 patients), broken out by 3 clinical descriptors {ethnic group (white, hispanic or black), coronary artery disease (yes or no), and left ventricular function (normal or abnormal, as measured by reduced LV ejection fraction)} were calculated.

The results showed that the G allele appears to be more frequent in blacks>whites>hispanics, and more frequent in patients with abnormal LV function (a strong predictor of cardiovascular mortality). No apparent relationship with coronary artery disease was shown.

G. Transgenic Animals

Methods for making transgenic animals using a variety of transgenes have been described in Wagner et al., Proc. Nat. Acad. Sc. U.S.A., Vol. 78, p. 5016, 1981; Stewart et al., Science, Vol. 217, p. 1046, 1982; Constantini et al., Nature, Vol. 294, p. 92, 1981; Lacy et al., Cell, Vol. 34, p. 343, 1983; McKnight et al., Cell, Vol. 34, p. 335, 1983; Brinstar et al., Nature, Vol. 306, p. 332, 1983; Palmiter et al., Nature, Vol. 300, p. 611, 1982; Palmiter et al., Cell, Vol. 29, p. 701, 1982 and Palmiter et al., Science, Vol. 222, p. 809, 1983. Such methods are described in U.S. Pat. Nos. 6,175,057; 6,180,849 and 6,133,502.

The term "transgene" is used herein to describe genetic material that has been or is about to be artificially inserted into the genome of a mammalian cell, particularly a mammalian cell of a living animal. The transgene is used to transform a cell, meaning that a permanent or transient genetic change, preferably a permanent genetic change, is induced in a cell following incorporation of exogenous DNA. A permanent genetic change is generally achieved by introduction of the DNA into the genome of the cell. Vectors for stable integration include, but are not limited to, plasmids, retroviruses and other animal viruses and YACS. Of interest are transgenic mammals, including, but are not limited to, cows, pigs, goats, horses and others, and particularly rodents, including rats and mice. Preferably, the transgenic-animals are mice.

Transgenic animals contain an exogenous nucleic acid sequence present as an extrachromosomal element or stably integrated in all or a portion of its cells, especially germ cells. Unless otherwise indicated, it will be assumed that a transgenic animal comprises stable changes to the germline sequence. During the initial construction of the animal, "chimeras" or "chimeric animals" are generated, in which only a subset of cells have the altered genome. Chimeras are primarily used for breeding purposes in order to generate the desired transgenic animal. Animals having a heterozygous alteration are generated by breeding of chimeras. Male and female heterozygotes are typically bred to generate homozygous animals.

The exogenous gene is usually either from a different species than the animal host, or is otherwise altered in its coding or non-coding sequence. The introduced gene may be a wild-type gene, naturally occurring polymorphism or a genetically manipulated sequence, for example having deletions, substitutions or insertions in the coding or non-coding regions. When the introduced gene is a coding sequence, it is usually operably linked to a promoter, which may be constitutive or inducible, and other regulatory sequences required for expression in the host animal.

Transgenic animals can comprise other genetic alterations in addition to the presence of alleles of AKAP genes. For example, the genome can be altered to affect the function of the endogenous genes, contain marker genes, or contain other genetic alterations (e.g., alleles of other genes associated with cardiovascular disease).

A "knock-out" of a gene means an alteration in the sequence of the gene that results in a decrease of function of the target gene, preferably such that target gene expression is undetectable or insignificant. A knock-out of an endogenous AKAP gene means that function of the gene has been substantially decreased so that expression is not detectable or only present at insignificant levels. "Knock-out" transgenics can be transgenic animals having a heterozygous knock-out of an AKAP gene or a homozygous knock-out. "Knock-outs" also include conditional knock-outs, where alteration of the target gene can occur upon, for example, exposure of the animal to a substance that promotes target gene alteration, introduction of an enzyme that promotes recombination at the target gene site (e.g., Cre in the Cre-lox system), or other method for directing the target gene alteration postnatally.

A "knock-in" of a target gene means an alteration in a host cell genome that results in altered expression (e.g., increased (including ectopic)) of the target gene, e.g., by introduction of an additional copy of the target gene, or by operatively inserting a regulatory sequence that provides for enhanced expression of an endogenous copy of the target gene. "Knock-in" transgenics of interest can be transgenic animals having a knock-in of an AKAP gene. Such transgenics can be heterozygous or homozygous for the knock-in gene. "Knock-ins" also encompass conditional knock-ins.

A construct is suitable for use in the generation of transgenic animals if it allows the desired level of expression of an AKAP encoding sequence or the encoding sequence of another gene associated with cardiovascular disease. Methods of isolating and cloning a desired sequence, as well as suitable constructs for expression of a selected sequence in a host animal, are well known in the art and are described below.

For the introduction of a gene into the subject animal, it is generally advantageous to use the gene as a gene construct wherein the gene is ligated downstream of a promoter capable of and operably linked to expressing the gene in the subject animal cells. Specifically, a transgenic non-human mammal showing high expression of the desired gene can be created by microinjecting a vector ligated with said gene into a fertilized egg of the subject non-human mammal (e.g., rat fertilized egg) downstream of various promoters capable of expressing the protein and/or the corresponding protein derived from various mammals (rabbits, dogs, cats, guinea pigs, hamsters, rats, mice etc., preferably rats etc.) Useful vectors include Escherichia coli-derived plasmids, Bacillus subtilis-derived plasmids, yeast-derived plasmids, bacteriophages such as lambda, phage, retroviruses such as Moloney leukemia virus, and animal viruses such as vaccinia virus or baculovirus.

Useful promoters for such gene expression regulation include, for example, promoters for genes derived from viruses (cytomegalovirus, Moloney leukemia virus, JC virus, breast cancer virus etc.), and promoters for genes derived from various mammals (humans, rabbits, dogs, cats, guinea pigs, hamsters, rats, mice etc.) and birds (chickens etc.) (e.g., genes for albumin, insulin II, erythropoietin, endothelin, osteocalcin, muscular creatine kinase, platelet-derived growth factor beta, keratins K1, K10 and K14, collagen types I and II, atrial natriuretic factor, dopamine beta-hydroxylase, endothelial receptor tyrosine kinase (generally abbreviated Tie2), sodium-potassium adenosine triphosphorylase (generally abbreviated Na,K-ATPase), neurofilament light chain, metallothioneins I and IIA, metalloproteinase I tissue inhibitor, MHC class I antigen (generally abbreviated H-2L), smooth muscle alpha actin, polypeptide chain elongation factor 1 alpha (EF-1 alpha), beta actin, alpha and beta myosin heavy chains, myosin light chains 1 and 2, myelin base protein, serum amyloid component, myoglobin, renin etc.).

It is preferable that the above-mentioned vectors have a sequence for terminating the transcription of the desired messenger RNA in the transgenic animal (generally referred to as terminator); for example, gene expression can be manipulated using a sequence with such function contained in various genes derived from viruses, mammals and birds. Preferably, the simian virus SV40 terminator etc. are commonly used. Additionally, for the purpose of increasing the expression of the desired gene, the splicing signal and enhancer region of each gene, a portion of the intron of a eukaryotic organism gene may be ligated 5' upstream of the promoter region, or between the promoter region and the translational region, or 3' downstream of the translational region as desired.

A translational region for a protein of interest can be obtained using the entire or portion of genomic DNA of blood, kidney or fibroblast origin from various mammals (humans, rabbits, dogs, cats, guinea pigs, hamsters, rats, mice etc.) or of various commercially available genomic DNA libraries, as a starting material, or using complementary DNA prepared by a known method from RNA of blood, kidney or fibroblast origin as a starting material. Also, an exogenous gene can be obtained using complementary DNA prepared by a known method from RNA of human fibroblast origin as a starting material. All these translational regions can be used in transgenic animals.

To obtain the translational region, it is possible to prepare DNA incorporating an exogenous gene encoding the protein of interest in which the gene is ligated downstream of the above-mentioned promoter (preferably upstream of the translation termination site) as a gene construct capable of being expressed in the transgenic animal.

DNA constructs for random integration need not include regions of homology to mediate recombination. Where homologous recombination is desired, the DNA constructs will comprise at least a portion of the target gene with the desired genetic modification, and will include regions of homology to the target locus. Conveniently, markers for positive and negative selection are included. Methods for generating cells having targeted gene modifications through homologous recombination are known in the art. For various techniques for transfecting mammalian cells, see Keown et al. (1990) Methods in Enzymology 185:527–537.

The transgenic animal can be created by introducing an AKAP gene construct into, for example, an unfertilized egg, a fertilized egg, a spermatozoon or a germinal cell containing a primordial germinal cell thereof, preferably in the embryogenic stage in the development of a non-human mammal (more preferably in the single-cell or fertilized cell stage and generally before the 8-cell phase), by standard means, such as the calcium phosphate method, the electric pulse method, the lipofection method, the agglutination method, the microinjection method, the particle gun method, the DEAE-dextran method and other such method. Also, it is possible to introduce a desired AKAP gene into a somatic cell, a living organ, a tissue cell or other cell, by gene transformation methods, and use it for cell culture, tissue culture and any other method of propagation. Furthermore, these cells may be fused with the above-described germinal cell by a commonly known cell fusion method to create a transgenic animal.

For embryonic stem (ES) cells, an ES cell line may be employed, or embryonic cells may be obtained freshly from a host, e.g. mouse, rat, guinea pig, etc. Such cells are grown on an appropriate fibroblast-feeder layer or grown in the presence of appropriate growth factors, such as leukemia inhibiting factor (LIF). When ES cells have been transformed, they may be used to produce transgenic animals. After transformation, the cells are plated onto a feeder layer in an appropriate medium. Cells containing the construct may be detected by employing a selective medium. After sufficient time for colonies to grow, they are picked and analyzed for the occurrence of homologous recombination or integration of the construct. Those colonies that are positive may then be used for embryo manipulation and blastocyst injection. Blastocysts are obtained from 4 to 6 week old superovulated females. The ES cells are trypsinized, and the modified cells are injected into the blastocoel of the blastocyst. After injection, the blastocysts are returned to each uterine horn of pseudopregnant females. Females are then allowed to go to term and the resulting litters screened for mutant cells having the construct. By providing for a different phenotype of the blastocyst and the ES cells, chimeric progeny can be readily detected. The chimeric animals are screened for the presence of the modified gene and males and females having the modification are mated to produce homozygous progeny. If the gene alterations cause lethality at some point in development, tissues or organs can be maintained as allogeneic or congenic grafts or transplants, or in in vitro culture.

Animals containing more than one transgene, such as allelic variants of AKAP genes and/or other genes associated with morbidity and/or mortality can be made by sequentially introducing individual alleles into an animal in order to produce the desired phenotype (manifestation of morbidity and/or predisposition to early mortality).

H. Effect of Allelic Variants The effect of an allelic variant on a AKAP10 gene expression (amount of mRNA, mRNA stability) and AKAP protein (amount, stability, intracellular localization, activity) can be determined according to methods known in the art. Allelic variants of AKAP genes can be assayed individually or in combination.

In general, any method known to those skilled in the art of determining the presence or absence of a specific messenger RNA transcript or a specific translated protein can be used to presence of absence of a polymorphic protein or a polymorphism in the genetic sequence.

1. RNA Analysis

A. Northern Blot Detection of RNA

The northern blot technique is used to identify a RNA fragment of a specific size from a complex population of RNA using gel electrophoresis and nucleic acid hybridization. Northern blotting is a well-known technique in the art. Northern blot analysis is commonly used to detect specific RNA transcripts expressed in a variety of biological samples and have been described in Sambrook, J. et al. (Molecular Cloning, 3$^{rd}$ Edition, Cold Spring Harbor Press).

Briefly, total RNA is isolated from any biological sample by the method of Chomczynski and Sacchi (Anal. Biochem. (1987) 162, 156–159). Poly-adenylated mRNA is purified from total RNA using mini-oligo (dT) cellulose spin column kit with methods as outlined by the suppliers (Invitrogen, Carlsbad Calif.). Denatured RNA is electrophoresed through a denaturing 1.5% agarose gel and transferred onto a nitrocellulose or nylon based matrix. The mRNAs are detected by hybridization of a radiolabeled or biotinylated oligonucleotide probe specific to the polymorphic regions as disclosed herein.

B. Dot Blot/Slot Blot

Specific RNA transcripts can be detected using dot and slot blot assays to evaluate the presence of a specific nucleic acid sequence in a complex mix of nucleic acids. Specific RNA transcripts can be detected by adding the RNA mixture to a prepared nitrocellulose or nylon membrane. RNA is detected by the hybridization of a radiolabeled or biotinylated oligonucleotide probe complementary to the AKAP sequences as disclosed herein.

C. RT-PCR

The RT-PCR reaction may be performed, as described by K.-Q. Hu et al., Virology 181:721–726 (1991), as follows: the extracted mRNA is transcribed in a reaction mixture 1 micromolar antisense primer, and 25 U AMV (avian myeloblastosis virus) or MMLV (Moloney murine leukemia virus) reverse transcriptase. Reverse transcription is performed and the cDNA is amplified in a PCR reaction volume with Taq polymerase. Optimal conditions for cDNA synthesis and thermal cycling can be readily determined by those skilled in the art.

2. Protein and Polypeptide Detection

Expression of Protein in a Cell Line

Using the disclosed nucleic acids AKAP10 proteins may be expressed in a recombinantly engineered cell such as bacteria, yeast, insect, mammalian, or plant cells. Those of ordinary skill in the art are knowledgeable in the numerous expression systems available for expression of a nucleic acid encoding proteins such as polymorphic human AKAP10 proteins.

A. Expression of AKAP Protein

The isolated nucleic acid encoding a full-length polymorphic human AKAP10 protein, or a portion thereof, such as a fragment containing the site of the polymorphism, may be introduced into a vector for transfer into host cells. Fragments of the polymorphic human AKAP10 proteins can be produced by those skilled in the art, without undue experimentation, by eliminating portions of the coding sequence from the isolated nucleic acids encoding the full-length proteins.

Expression vectors are used expression of the protein in the host cell is desired. An expression vector includes vectors capable of expressing nucleic acids that are operatively linked with regulatory sequences, such as promoter regions, that are capable of effecting expression of such nucleic acids. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome. Such plasmids for expression of polymorphic human AKAP10-encoding nucleic acids in eukaryotic host cells, particularly mammalian cells, include cytomegalovirus (CMV) promoter-containing vectors, such as pCMV5, the pSV2dhfr expression vectors, which contain the SV40 early promoter, mouse dhfr gene, SV40 polyadenylation and splice sites and sequences necessary for maintaining the vector in bacteria, and MMTV promoter-based vectors.

The nucleic acids encoding polymorphic human AKAP10 proteins, and vectors and cells containing the nucleic acids as provided herein permit production of the polymorphic proteins, as well as antibodies to the proteins. This provides a means to prepare synthetic or recombinant polymorphic human AKAP10 proteins and fragments thereof that are substantially free of contamination from other AKAPs and proteins in general, the presence of which can interfere with analysis of the polymorphic proteins. In addition, the polymorphic proteins may be expressed in combination with selected other proteins that AKAP10 may associate with in cells. The ability to selectively express the polymorphic AKAP10 proteins alone or in combination with other selected proteins makes it possible to observe the functioning of the recombinant polymorphic proteins within the environment of a cell. The expression of isolated nucleic acids encoding an AKAP protein will typically be achieved by operably linking, for example, the DNA or cDNA to a promoter (which is either constitutive or regulatable), followed by incorporation into an expression vector. The vectors can be suitable for replication and integration in either prokaryotes or eukaryotes. Typical expression vectors contain transcription and translation terminators, initiation sequences, and promoters useful for regulation of the expression of the DNA encoding a protein. To obtain high level expression of a cloned gene, it is desirable to construct expression vectors which contain, a strong promoter to direct transcription, a ribosome binding site for translational initiation, and a transcription/translation terminator. One of ordinary skill in the art would recognize that modifications can be made to an AKAP10 protein without diminishing its biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids (e.g., poly His) placed on either terminus to create conveniently located purification sequences. Restriction sites or termination codons can also be introduced. There are expression vectors that specifically allow the expression of functional proteins. One such vector, Plasmid 577, described in U.S. Pat. No. 6,020,122 and incorporated herein by reference, has been constructed for the expression of secreted antigens in a permanent cell line. This plasmid contains the following DNA segments: (a) a fragment of pBR322 containing bacterial beta-lactamase and origin of DNA replication; (b) a cassette directing expression of a neomycin resistance gene under control of HSV-1 thymidine kinase promoter and poly-A addition signals; (c) a cassette directing expression of a dihydrofolate reductase gene under the control of a SV-40 promoter and poly-A addition signals; (d) cassette directing expression of a rabbit immunoglobulin heavy chain signal sequence fused to a modified hepatitis C virus (HCV) E2 protein under the control of the Simian Virus 40 T-Ag promoter and transcription enhancer, the hepatitis B virus surface antigen (HBsAg) enhancer I followed by a fragment of Herpes Simplex Virus-1 (HSV-1) genome providing poly-A addition signals; and (e) a fragment of Simian Virus 40 genome late region of no function in this plasmid. All of the segments of the vector were assembled by standard methods known to those skilled in the art of molecular biology. Plasmids for the expression of secreted AKAP proteins can be constructed by replacing the hepatitis C virus E2 protein coding sequence in plasmid 577 with a AKAP sequence of SEQ ID NO: 3 or a fragment thereof. The resulting plasmid is transfected into CHO/dhfr-cells (DXB-111) (Uriacio, et al., PNAS 77, 4451–4466; 1980); these cells are available from the A.T.C.C., 12301 Parklawn Drive, Rockville, Md. 20852, under Accession No. CRL 9096), using the cationic liposome-mediated procedure (P. L. Felgner et al., PNAS 84:7413–7417 (1987). Proteins are secreted into the cell culture media.

Incorporation of cloned DNA into a suitable expression vector, transfection of cells with a plasmid vector or a combination of plasmid vectors, each encoding one or more distinct proteins or with linear DNA, and selection of transfected cells are well known in the art (see, e.g., Sambrook et al. (1989) *Molecular Cloning: A Laboratory Manual*, Second Edition, Cold Spring Harbor Laboratory Press). Heterologous nucleic acid may be introduced into host cells by any method known to those of skill in the art, such as transfection with a vector encoding the heterologous nucleic acid by $CaPO_4$ precipitation (see, e.g., Wigler et al. (1979) *Proc. Natl. Acad. Sc. USA* 76:1373–1376) or lipofectamine (GIBCO BRL #18324-012). Recombinant cells can then be cultured under conditions whereby the polymorphic human AKAP10 protein encoded by the nucleic acid is expressed. Suitable host cells include mammalian cells (e.g., HEK293, including but are not limited to, those described in U.S. Pat. No. 5,024,939 to Gorman (see, also, Stillman et al. (1985) *Mol. Cell. Biol.* 5:2051–2060); also, HEK293 cells available from ATCC under accession #CRL 1573), CHO, COS, BHKBI and Ltk⁻ cells, mouse monocyte macrophage P388D1 and J774A-1 cells (available from ATCC, Rockville, Md.) and others known to those of skill in this art), yeast cells, including, but are not limited to, *Pichia pastoris, Saccharomyces cerevisiae, Candida tropicalis, Hansenula polymorpha*, human cells and bacterial cells, including, but not limited to, *Escherichia coli*. Xenopus oöcytes may also be used for expression of in vitro RNA transcripts of the DNA.

Heterologous nucleic acid may be stably incorporated into cells or may be transiently expressed using methods known in the art. Stably transfected mammalian cells may be prepared by transfecting cells with an expression vector having a selectable marker gene (such as, for example, the gene for thymidine kinase, dihydrofolate reductase, neomycin resistance, and the like), and growing the transfected cells under conditions selective for cells expressing the marker gene. To prepare transient transfectants, mammalian cells are transfected with a reporter gene (such as the *E. coli* β-galactosidase gene) to monitor transfection efficiency. Selectable marker genes are not included in the transient transfections because the transfectants are typically not grown under selective conditions, and are usually analyzed within a few days after transfection.

Heterologous nucleic acid may be maintained in the cell as an episomal element or may be integrated into chromosomal DNA of the cell. The resulting recombinant cells may then be cultured or subcultured (or passaged, in the case of mammalian cells) from such a culture or a subculture thereof. Methods for transfection, injection and culturing recombinant cells are known to the skilled artisan. Similarly, the polymorphic human AKAP10 proteins or fragments thereof may be purified using protein purification methods known to those of skill in the art. For example, antibodies or other ligands that specifically bind to the proteins may be used for affinity purification and immunoprecipitation of the proteins.

B. Protein Purification

The AKAP10 proteins may be purified by standard techniques well known to those of skill in the art. Recombinantly produced proteins can be directly expressed or expressed as a fusion protein. The recombinant protein is purified by a combination of cell lysis (e.g., sonication, French press) and affinity chromatography. The proteins, recombinant or synthetic, may be purified to substantial purity by standard techniques well known in the art, including detergent solubilization, selective precipitation with such substances as ammonium sulfate, column chromatography, immunopurification methods, and others. (See, for example, R. Scopes, Protein Purification: Principles and Practice, Springer-Verlag: New York (1982); Deutscher, Guide to Protein Purification, Academic Press (1990)). For example, antibodies may be raised to the proteins as described herein. Purification from *E. coli* can be achieved following procedures described in U.S. Pat. No. 4,511,503. The protein may then be isolated from cells expressing the protein and further purified by standard protein chemistry techniques as described herein. Detection of the expressed protein is achieved by methods known in the art and include, for example, radioimmunoassays, Western blotting techniques or immunoprecipitation.

3. Immunodetection of the AKAP10 Protein.

Generally, the AKAP proteins, when presented as an immunogen, should elicit production of a specifically reactive antibody. Immunoassays for determining binding are well known to those of skill in the art, as are methods of making and assaying for antibody binding specificity/affinity. Exemplary immunoassay formats include ELISA, competitive immunoassays, radioimmunoassays, Western blots, indirect immunofluorescent assays, in vivo expression or immunization protocols with purified protein preparations. In general, the detection of immunocomplex formation is well known in the art and may be achieved by methods generally based upon the detection of a label or marker, such as any of the radioactive, fluorescent, biological or enzymatic tags. Labels are well known to those skilled in the art (see U.S. Pat. Nos. 3,817,837; 3,850,752; 3,939,350; 3,996,345; 4,277,437; 4,275,149 and 4,366,241, each incorporated herein by reference). Of course, one may find additional advantages through the use of a secondary binding ligand such as a second antibody or a biotin/avidin ligand binding arrangement, as is known in the art.

A. Production of Polyclonal Antisera Against AKAP

Antibodies can be raised to AKAP proteins, including individual, allelic, strain, or species variants, and fragments thereof, both in their naturally occurring (full-length) forms and in recombinant forms. Additionally, antibodies are raised to these proteins in either their native configurations or in non-native configurations. Anti-idiotypic antibodies can also be generated. A variety of analytic methods are available to generate a hydrophilicity profile of proteins. Such methods can be used to guide the artisan in the selection of peptides for use in the generation or selection of antibodies which are specifically reactive, under immunogenic conditions. See, e.g., J. Janin, Nature, 277 (1979) 491–492; Wolfenden, et al., Biochemistry 20(1981) 849–855; Kyte and Doolite, J. Mol. Biol. 157 (1982) 105–132; Rose, et al., Science 229 (1985) 834–838.

A number of immunogens can be used to produce antibodies specifically reactive with AKAP proteins. An isolated recombinant, synthetic, or native polynucleotide are the preferred immunogens (antigen) for the production of monoclonal or polyclonal antibodies. Polypeptides are typically denatured, and optionally reduced, prior to formation of antibodies for screening expression libraries or other assays in which a putative AKAP protein is expressed or denatured in a non-native secondary, tertiary, or quarternary structure.

The AKAP protein (SEQ ID NO: 4, or a portion thereof) is injected into an animal capable of producing antibodies. Either monoclonal or polyclonal antibodies can be generated for subsequent use in immunoassays to measure the presence and quantity of the protein. Methods of producing polyclonal antibodies are known to those of skill in the art. In brief, an immunogen (antigen), preferably a purified protein, a protein coupled to an appropriate carrier (e.g., GST, keyhole limpet hemanocyanin, etc.), or a protein incorporated into an immunization vector such as a recombinant vaccinia virus (see, U.S. Pat. No. 4,722,848) is mixed with an adjuvant and animals are immunized with the mixture. The animal's immune response to the immunogen preparation is monitored by taking test bleeds and determining the titer of reactivity to the protein of interest. When appropriately high titers of antibody to the immunogen are obtained, blood is collected from the animal and antisera are prepared. Further fractionation of the antisera to enrich for antibodies reactive to the protein is performed where desired (See, e.g., Coligan, Current Protocols in Immunology, Wiley/Greene, NY (1991); and Harlow and Lane, Antibodies: A Laboratory Manual, Cold Spring Harbor Press, NY (1989)).

B. Western Blotting of Tissue Samples for the AKAP Protein

Biological samples are homogenized in SDS-PAGE sample buffer (50 mM Tris-HCl, pH 6.8, 100 mM dithiothreitol, 2% SDS, 0.1% bromophenol blue, 10% glycerol), heated at 100 degrees Celsius for 10 min and run on a 14% SDS-PAGE with a 25 mM Tris-HCl, pH 8.3, 250 mM Glycine, 0.1% SDS running buffer. The proteins are electrophoretically transferred to nitrocellulose in a transfer buffer containing 39 mM glycine, 48 mM Tris-HCl, pH 8.3, 0.037% SDS, 20% methanol. The nitrocellulose is dried at room temperature for 60 min and then blocked with a PBS solution containing either bovine serum albumin or 5% nonfat dried milk for 2 hours at 4 degrees Celsius.

The filter is placed in a heat-sealable plastic bag containing a solution of 5% nonfat dried milk in PBS with a 1:100 to 1:2000 dilution of affinity purified anti-AKAP peptide antibodies, incubated at 4 degrees Celsius for 2 hours, followed by three 10 min washes in PBS. An alkaline phosphatase conjugated secondary antibody (i.e., anti-mouse/rabbit IgG), is added at a 1:200 to 1:2000 dilution to the filter in a 150 mM NaCl, 50 mM Tris-HCl, pH 7.5 buffer and incubated for 1 h at room temperature.

The bands are visualized upon the addition and development of a chromogenic substrate such as 5-bromo-4-chloro-3-indolyl phosphate/nitro blue tetrazolium (BCIP/NBT). The filter is incubated in the solution at room temperature until the bands develop to the desired intensity. Molecular mass determination is made based upon the mobility of pre-stained molecular weight standards (Rainbow markers, Amersham, Arlington Heights, Ill.).

C. Microparticle Enzyme Immunoassay (MEIA)

AKAP10 proteins and peptides are detected using a standard commercialized antigen competition EIA assay or polyclonal antibody sandwich EIA assay on the IMx.RTM Analyzer (Abbott Laboratories, Abbott Park, Ill.). Samples containing the AKAP10 protein are incubated in the presence of anti-AKAP10 coated microparticles. The microparticles are washed and secondary polyclonal anti-AKAP10 antibodies conjugated with detectable entities (i.e., alkaline phosphatase) are added and incubated with the microparticles. The microparticles are washed and the bound antibody/antigen/antibody complexes are detected by adding a substrate (i.e. 4-methyl umbelliferyl phosphate) (MUP) that will react with the secondary conjugated antibody to generate a detectable signal.

D. Immunocytochemistry

Intracellular localization of the AKAP10 protein can be determined by a variety of in situ hybridization techniques. In one method cells are fixed with fixed in 4% paraformaldehyde in 0.1 M phosphate buffered saline (PBS; pH7.4) for 5 min., rinsed in PBS for 2 min., dilapidated and dehydrated in an ethanol series (50, 70 and 95%) (5 min. each and stored in 95% ethanol at 4 degrees Celsius).

The cells are stained with the primary anti-AKAP10 antibody and a mixture of secondary antibodies used for detection. Laser-scanning confocal microscopy is performed to localize the AKAP10 protein.

4. Binding Assays

Assays to measure the interaction between AKAP10 and the regulatory subunits RI and/or RII of the Protein Kinase A holoenzyme include immobilized binding assays, solution binding assays and the like. In some instances, it may be desirable to monitor binding between AKAP10 and PKA. In other instances, it may be desirable to specifically monitor the binding between AKAP10 and a cellular component (other than PKA) to which it binds. Assays may be performed in a variety of formats, including cell-based assays, such as di-hybrid screening or complementation assays as described in U.S. Pat. No. 5,283,173 and Patent Cooperation Treaty (PCT) Publication No. WO 91/16457, respectively. Assays of this type are particularly useful for assessing intracellular efficacy of test compounds. Non-cell-based assays include scintillation proximity assays, cAMP competition assays, ELISA assays, radioimmunoassays, chemiluminescent assays, and the like. Such assay procedures are well known in the art and generally described, e.g., in Boudet et al., J. Immunol. Meth., 142:73–82 (1991); Ngai et al., J. Immunol. Meth., 158:267–276 (1993); Pruslin et al., J. Immunol. Meth., 137:27–35 (1991); Udenfriend et al., Proc. Natl. Acad. Sci. USA, 82:8672–8676 (1985); Udenfriend et al., Anal. Biochem., 161:494–500 (1987); Bosworth and Towers, Nature, 341:167–168 (1989); Gilman, Proc. Natl. Acad. Sci. USA, 67:305–312 (1970); and U.S. Pat. No. 4,568,649.

A. In vitro Binding Assay

Huang et al. Proc. Natl. Acad. Sci. USA, 272:8057–8064 (1997); Protein preparations containing AKAP10 are incubated with glutathione resin in PBS for 2 hours at 4 degrees Celsius with 0.1% Triton X-100, 1 mM phenylmethylsulfonyl fluoride, 1 mM EDTA, 5 mM benzamidine, and 5 mM β-mercaptoethanol and washed extensively with the same buffer. 200 micrograms of PKA regulatory subunit RII and/or RI were added to the resin and incubated at 4 degrees Celsius. Proteins associated with the AKAP10 are eluted and analyzed by Laemmli electrophoresis. The proteins were visualized by Coomassie Staining. PKA proteins can be radiolabeled or labeled with a flurophore to allow detection.

B. PKA Phosphorylation of Protein Substrate

Cyclic AMP-dependent protein kinase (PKA) catalyzes the transfer of gamma phosphate from adenosine triphosphate (ATP) to a serine or threonine residue in a protein substrate. A short synthetic peptide (Leucine-Arg-Arg-Alanine-Serine-Leucine-Glycine or LRRASLG) is used as a substrate to assay the specific type of PKA activity as described in Pearson et. al., Methods of Enzymology 200, 62–81 (1991).

The PKA assay is typically carried out in a reaction of the enzyme with a peptide substrate and gamma $^{32}$P-ATP followed by separation of the $^{32}$P-peptide product from the unreacted gamma $^{32}$P-ATP on a phosphocellulose membrane. This method requires at least one basic amino acid residue in the peptide substrate. The peptide substrate can be tagged with a biotin group so that the biotinylated $^{32}$P-peptide product consistently binds to a streptavidin membrane in a manner independent of the peptide sequence as described in Goueli et al Analytical Biochemistry 225, 10–17, (1995). The separation of the $^{32}$P-peptide product from the free gamma $^{32}$P-ATP using affinity binding and ultrafiltration separation to analyze a mixture sample as described in U.S. Pat. No. 5,869,275

If the mutation is located in an intron, the effect of the mutation can be determined, e.g., by producing transgenic animals in which the allelic variant has been introduced and in which the wild-type gene or predominant allele may have been knocked out. Comparison of the level of expression of the protein in the mice transgenic for the allelic variant with mice transgenic for the predominant allele will reveal whether the mutation results in increased or decreased synthesis of the associated protein and/or aberrant tissue distribution or intracellular localization of the associated protein. Such analysis could also be performed in cultured cells, in which the human variant allele gene is introduced and, e.g., replaces the endogenous gene in the cell. For mutant AKAP proteins binding to signalling enzymes such as PKA is also examined. Thus, depending on the effect of the alteration a specific treatment can be administered to a subject having such a mutation. Accordingly, if the mutation results in decreased production of AKAP protein, the subject can be treated by administration of a compound which increases synthesis, such as by increasing AKAP gene expression, and wherein the compound acts at a regulatory element different from the one which is mutated. Alternatively, if the mutation results in increased AKAP protein, the subject can be treated by administration of a compound which reduces protein production, e.g., by reducing AKAP gene expression or a compound which inhibits or reduces the activity of AKAP protein.

I. Diagnostic and Prognostic Assays

Typically, an individual allelic variant that associates with morbidity and/or mortality and/or an alteration in signal transduction will not be used in isolation as a prognosticator. An allelic variant typically will be one of a plurality of indicators that are used. The other indicators may be the manifestation of other risk factors for morbidity and/or mortality and other evidence of altered signal transduction.

Useful combinations of allelic variants of the AKAP10 gene can be determined. Variants can be assayed individually or assayed simultaneously using multiplexing methods as described above or any other labelling method that allows different variants to be identified. In particular, variants of the AKAP10 gene may be assayed using kits (see below) or any of a variety microarrays known to those in the art. For example, oligonucleotide probes comprising the polymorphic regions surrounding any polymorphism in the AKAP10 gene may be designed and fabricated using methods such as those described in U.S. Pat. Nos. 5,492,806; 5,525,464; 5,695,940; 6,018,041; 6,025,136; WO 98/30883; WO 98/56954; WO99/09218; WO 00/58516; WO 00/58519, or references cited therein.

J. Screening Assays for Modulators

Modulators of AKAP10 biological activities may be identified by using any of the disclosed methods related to AKAP10 binding to PKA, AKAP10 localization in the mitochondria, binding to other signaling enzymes and phosphorylation by PKA.

In particular, once a variant protein such as AKAP10-5 is contacted with a potential modulating molecule the effect of the molecule on the binding between AKAP protein and PKA can be determined by using the assays disclosed in the section entitled "Effect of Allelic Variants". For example mitochondria can be isolated from cells exposed to the potential modulating molecule. PKA protein can then be isolated and quantitated or phosphorylation can be determined using the disclosed PKA assay. An increase in the amount of PKA protein in the mitochondria or the quantity of test peptide phosphorylated by mitochondrial isolated PKA would indicate a positive effect of the test molecule. Binding of AKAP10 protein and PKA could be directly assessed using an in vitro binding assay, or other disclosed binding assays, or by immunoassays such as immunoprecipitation.

For allelic variants that do not alter the AKAP10 protein the effect of a potential modulating molecule can be assayed by examining PKA RNA using the various methods disclosed for RNA analysis.

K. Ribozymes

A ribozyme targets the RNA genome and RNA transcripts and copies thereof. Each ribozyme molecule contains a catalytically active segment capable of cleaving the plus or minus strand of RNA, and further comprises flanking sequences having a nucleotide sequence complementary to portions of the target RNA. The flanking sequences serve to anneal the ribozyme to the RNA in a site-specific manner. Absolute complementarity of the flanking sequences to the target sequence is not necessary, however, as only an amount of complementarity sufficient to form a duplex with the target RNA and to allow the catalytically active segment of the ribozyme to cleave at the target sites is necessary. Thus, only sufficient complementarity to permit the ribozyme to be hybridizable with the target RNA is required. In preferred embodiments of the present invention the enzymatic RNA molecule is formed in a hammerhead motif but the ribozyme may also be formed in the motif of a hairpin, hepatitis delta virus, group I intron or RNAse P RNA (in association with an RNA guide sequence). Examples of hammerhead motifs are described by Rossi et al., AIDS Res. Hum. Retrovir. 8:183 (1992), hairpin motifs are described by Hampel et al., Biochem. 28:4929 (1989) and Hampel et al., Nucl. Acids Res. 18:299 (1990), the hepatitis delta virus motif is exemplified in Perrotta and Been, Biochem. 31:16 (1992), an RNAseP motif is described in Gueerier-Takada et al., Cell 35:849 (1983), and examples of the group I intron motif are described in Cech et al., U.S. Pat. No. 4,987,071, each of the foregoing disclosures being incorporated herein by reference.

Ribozymes may be prepared by chemical synthesis or produced by recombinant vectors according to methods established for the synthesis of RNA molecules. See, e.g., Sambrook et al., Molecular Cloning, A Laboratory Manual, 2d ed., Gold Spring Harbor Laboratory Press, Cold Spring Harbor, N.Y. (1989), incorporated herein by reference. The ribozyme sequence may be synthesized, for example, using RNA polymerases such as T7 or SP6. The ribozymes may be prepared from a corresponding DNA sequence (DNA which on transcription yields a ribozyme) operably linked to an RNA polymerase promoter such as the promoter for T7 RNA polymerase or SP6 RNA polymerase. A DNA sequence corresponding to a ribozyme may be ligated in to a DNA vector, such as a plasmid, bacteriophage or other virus. Where the transfer vector contains an RNA polymerase promoter operably linked to DNA corresponding to a ribozyme, the ribozyme may be conveniently produced upon incubation with an RNA polymerase. Ribozymes may therefore be produced in vitro by incubation of RNA polymerase with an RNA polymerase promoter operably linked to DNA corresponding to a ribozyme, in the presence of ribonucleotides. In vivo, prokaryotic or eukaryotic cells (including mammalian cells) may be transfected with an appropriate vector containing genetic material corresponding to a ribozyme, operably linked to an RNA polymerase promoter such that the ribozyme is transcribed in the host cell. Ribozymes may be directly transcribed in vivo from a transfer vector, or alternatively, may be transcribed as part of a larger RNA molecule. For example, DNA corresponding to ribozyme sequence may be ligated into the 3' end of a carrier gene, for example, after a translation stop signal. Larger RNA molecules may help to stabilize the ribozyme molecules against nuclease digestion within the cells. On translation the carrier gene may give rise to a protein, whose presence can be directly assayed if desired, for example, by enzymatic reaction when the carrier gene encodes an enzyme.

Those of ordinary skill in the art based on the above description and the sequences disclosed herein can design ribozymes to target RNA representing the allelic variants of the AKAP10 gene. For example, the sequence of anti-AKAP10-5 hammerhead ribozyme is 5-UGCA CUGANGAGCCUGGACGAAACU-3' (SEQ ID NO: 25). The sequence UGCA is complementary to target RNA with C hybridizing to the G nucleotide at position 2073 of SEQ ID NO: 3 of the AKAP10-5 allelic variant. The simplest hammerhead ribozyme must have UG at the 5' end of the substrate binding site.

L. Kits

Kits can be used to indicate whether a subject is at risk of increased susceptibility to morbidity and/or predisposition for premature or increased or early mortality. The kits can also be used to determine if a subject has a genetic predisposition to a disorder related to signal transduction. This information could be used, e.g., to optimize treatment of such individuals as a particular genotype may be associated with drug response.

The kits comprise a probe or primer which is capable of hybridizing adjacent to or at a polymorphic region of AKAP10 and thereby identifying whether the AKAP10 gene contains an allelic variant which is associated with increased susceptibility to morbidity and/or predisposition for premature or increased or early mortality or a genetic predisposition to a disorder related to signal transduction and/or protein phosphorylation. The kits further comprise instructions for use in carrying out assays, interpreting results and diagnosing a subject as having increased susceptibility to morbidity and/or predisposition for premature or increased or early mortality or a genetic predisposition to a disorder related to signal transduction and/or protein phosphorylation.

Kits for amplifying a region of AKAP10 gene or other genes associated with morbidity and/or mortality and/or signal transduction comprise two primers which flank a polymorphic region of the gene of interest. For example primers can comprise the sequences of SEQ ID NOs.:5, 6, 7, 10, 12 and 16. For other assays, primers or probes hybridize to a polymorphic region or 5' or 3' to a polymorphic region depending on which strand of the target nucleic acid is used. For example, specific probes and primers comprise sequences designated as SEQ ID NOs: 8, 15, 19 and 20. Those of skill in the art can synthesize primers and probes which hybridize adjacent to or at the polymorphic regions described herein and other SNPs in genes associated with morbidity and/or mortality and/or signal transduction Yet other kits comprise at least one reagent necessary to perform an assay. For example, the kit can comprise an enzyme, such as a nucleic acid polymerase. Alternatively the kit can comprise a buffer or any other necessary reagent.

Yet other kits comprise microarrays of probes to detect allelic variants of the AKAP10 gene. The kits further comprise instructions for their use and interpreting the results.

The following examples are included for illustrative purposes only and are not intended to limit the scope of the invention. The practice of methods and development of the products provided herein employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Molecular Cloning A Laboratory Manual, 2nd Ed., ed. by Sambrook, Fritsch and Maniatis (Cold Spring Harbor Laboratory Press: 1989); DNA Cloning, Volumes I and II (D. N. Glover ed., 1985); Oligonucleotide Synthesis (M. J. Gait ed., 1984); Mullis et al. U.S. Pat. No. 4,683,195; Nucleic Acid Hybridization (B. D. Hames & S. J. Higgins eds. 1984); Transcription and Translation (B. D. Hames & S. J. Higgins eds. 1984); Culture of Animal Cells (R. I. Freshney, Alan R. Liss, Inc., 1987); Immobilized Cells and Enzymes (IRL Press, 1986); B. Perbal, A Practical Guide To Molecular Cloning (1984); the treatise, Methods In Enzymology (Academic Press, Inc., New York); Gene Transfer Vectors For Mammalian Cells (J. H. Miller and M. P. Cabs eds., 1987, Cold Spring Harbor Laboratory); Methods In Enzymobogy, Vols. 154 and 155 (Wu et al. eds., Immunochemical Methods In Cell and Molecular Biology (Mayer and Walker, eds., Academic Press, London, 1987); Handbook of Experimental Immunology, Volumes I–IV (D. M. Weir and C. C. Blackwell, eds., 1986); Manipulating the Mouse Embryo, (Cold Spring Harbor Laboratory Press, Cold Spring Harbor, N.Y., 1986).

The following examples are included for illustrative purposes only and are not intended to limit the scope of the invention.

EXAMPLE 1
Isolation of DNA from Blood Samples of a Healthy Donor Population

Healthy samples were obtained through the blood bank of San Bernardino, Calif. Both parents of the blood donors were of Caucasian origin. Practically a healthy subject, when human, is defined as human donor who passes blood bank criteria to donate blood for eventual use in the general population. These criteria are as follows: free of detectable viral, bacterial, mycoplasma, and parasitic infections; not anemic; and then further selected based upon a questionnaire regarding history. Thus, a healthy population represents an unbiased population of sufficient health to donate blood according to blood bank criteria, and not further selected for any disease state. Typically such individuals are not taking any medications.

Blood was obtained from a donor by venous puncture and preserved with 1 mM EDTA pH 8.0. Ten milliliters of whole blood from each donor was centrifuged at 2000×g. One milliliter of the buffy coat was added to 9 milliliters of 155 mM $NH_4Cl$, 10 mM $KHCO_3$, and 0.1 mM $Na_2EDTA$, incubated 10 minutes at room temperature and centrifuged for 10 minutes at 2000×g. The supernatant was removed, and the white cell pellet was washed in 155 mM $NH_4Cl$, 10 mM $KHCO_3$, and 0.1 mM $Na_2EDTA$ and resuspended in 4.5 milliliters of 50 mM Tris, 5 mM EDTA, and 1% SDS. Proteins were precipitated from the cell lysate by 6M ammonium acetate pH 7.3 and separated from the nucleic acid by centrifugation at 3000×g. The nucleic acid was recovered from the supernatant by the addition of an equal volume of 100% isopropanol and centrifugation at 2000×g. The dried nucleic acid pellet was hydrated in 10 mM Tris pH 7.6 and 1 mM $Na_2EDTA$ and stored at 4° C.

EXAMPLE 2
Detection of AKAP10-1 by MassEXTEND™ Assay Detection Methods

AKAP10-1 is an allele of the AKAP10 gene with a single nucleotide polymorphism at nucleotide number 156277 (based on the sequence of a genomic clone of the AKAP10 gene, GenBank Accession No. AC005730). The single nucleotide polymorphism is a T to C transversion located in the 3' non-translated region of the gene encoding AKAP10. PCR primers were synthesized by OPERON (Alameda, Calif.) using phosphoramidite chemistry. Amplification of the AKAP10 target sequence was carried out in single 50 µl PCR reaction with 25 ng of human genomic DNA obtained from samples as described in Example 1. Each reaction containing 1×PCR buffer (Qiagen, Valencia, Calif.), 200 µM dNTPs, 1 U Hotstar Taq polymerase (Qiagen, Valencia, Calif.), 4 mM $MgCl_2$, and 25 pmol of the forward primer containing the universal primer sequence and the target specific sequence 5'-TCTCAATCATGTGCATTGAGG-3' (SEQ ID NO: 5) 2 pmol of the reverse primer 5'-AGCGGAT AACAATTTCACACAGGGATCACACAGCCATCAGC AG-3' (SEQ ID NO: 6) and 10 pmol of a biotinylated universal primer complementary to the 5' end of the PCR amplicon 5'-AGCGGATAACAATTTCACAGAGG-3' (SEQ ID NO: 7). Alternatively, the biotinylated universal primer could be 5'-GGCGCACGCCTCCACG-3' (SEQ ID NO: 16). After an initial round of amplification of the target with the specific forward and reverse primer, the 5' biotinylated universal primer was hybridized and acted as a reverse primer thereby introducing a 3' biotin capture moiety into the molecule. The amplification protocol resulted in a 5'-biotinylated double stranded DNA amplicon, which dramatically reduces the cost of high throughput genotyping by eliminating the need to 5' biotin label each forward primer used in a genotyping. Thermal cycling was performed in 0.2 mL tubes or 96 well plate using an MJ Research Thermal Cycler (Waltham, Mass.) (calculated temperature) with the following cycling parameters: 94° C. for 5 mm; 45 cycles: 94° C. for 20 sec, 56° C. for 30 sec, 72° C. for 60 sec; 72° C. for 3 min.

The 50 µl PCR reaction was added to 25 µl of streptavidin coated magnetic bead (Dynal) prewashed three times and resuspended in 1M $NH_4Cl$, 0.06M $NH_4OH$. The PCR amplicons were allowed to bind to the beads for 15 minutes at room temperature. The beads were then collected with a magnet, and the supernatant containing unbound DNA was removed. The unbound strand was released from the double stranded amplicons by incubation in 100 mM NaOH and washing of the beads three times with 10 mM Tris pH 8.0.

Genotyping

Genotyping was carried out using the MassEXTEND™ assay and MALDI-TOF. The SNP identified at position 156277 of AKAP10 in the GenBank sequence is represented as a T to C transversion. The MassEXTEND™ assay detected the sequence of the complementary strand at the polymorphic position, thus the primer extension product incorporated either a T or a C. The DNA coated magnetic beads were resuspended in 26 mM Tris-HCl pH 9.5, 6.5 mM $MgCl_2$ and 50 mM each of dTTPs and 50 mM each of ddCTP, ddATP, ddGTP, 2.5U of a thermostable DNA polymerase (Amersham Pharmacia Biotech, Piscataway, N.J.) and 20 pmol of a template specific oligonucleotide primer 5'-GTGGCGCCCACGTGGTCAA-3' (SEQ ID NO: 8) (Operon, Alameda, Calif). Primer extension occurs with three cycles of oligonucleotide primer hybridization and extension. The extension products were analyzed after denaturation from the template with 50 mM $NH_4Cl$ and transfer of 150 nl each sample to a silicon chip preloaded with 150 nl of H3PA (3-hydroxy picolinic acid) (Sigma Aldrich, St. Louis, Mo.) matrix material. The sample material was allowed to crystallize and analyzed by MALDI-TOF (Bruker Daltonics, Billerica, Mass., PerSeptive, Foster City, Calif.). The mass of the primer used in the MassEXTEND™ reaction was 5500.6 daltons. The allelic variant results in the addition of ddC to the primer to produce an extension product having a mass of 5773.8 daltons. The predominant allele is extended by the addition of T and ddG to the primer to produce an extension product having a mass of 6101 daltons.

The SNP that is present in AKAP10-1 is a T to C transversion at nucleotide number 156277 of the sequence of a genomic clone of the AKAP10 gene (GenBank Accession No. AC005730) (SEQ ID NO: 17). SEQ ID NO:17 represents the nucleotide sequence of human chromosome 17, which contains the genomic nucleotide sequence of the human AKAP10 gene at approximately nucleotide 83,580 to nucleotide 156,577. SEQ ID NO: 18 represents the nucleotide sequence of human chromosome 17, which contains the genomic nucleotide sequence of the human AKAP10-1 allele.

The frequency of the AKAP10-1 allelic variant was measured in a population of age selected healthy individuals. Five hundred fifty-two (552) individuals between the ages of 18–39 years (276 females, 276 males) and 552 individuals between the ages of 60–79 (184 females between the ages of 60–69, 368 males between the age of 60–79) were tested for the presence of the allelic variant localized in the non-translated 3' region of AKAP 10. Differences in the frequency of this variant with increasing age groups were observed among healthy individuals. Statistical analysis showed that the significance level for differences in the allelic frequency for alleles between the "younger" and the "older" populations was p=0.0009 and for genotypes was p=0.003. Differences between age groups are significant. For the total population allele significance is p=0.0009, and genotype significance is p=0.003. The young and old populations were in Hardy-Weinberg equilibrium. A preferential change of one particular genotype was not seen.

The polymorphism is localized in the non-translated 3'-region of the gene encoding the human protein kinase A anchoring protein (AKAP10). The gene is located on chromosome 17. Its structure includes 15 exons and 14 intervening sequences (introns). The encoded protein is responsible for the sub-cellular localization of the cAMP-dependent protein kinase and, therefore, plays a key role in the G-protein mediated receptor-signaling pathway (Huang et al. PNAS ([[1007]] 1997) 94:11184–11189). Since its localization is outside the coding region, this polymorphism is most likely in linkage disequilibrium (LD) with other non-synonymous polymorphisms that could cause amino acid substitutions and subsequently alter the function of the protein.

EXAMPLE 3

Discovery of AKAP10-5 Allele

Genomic DNA was isolated from blood (see Example 1) of seventeen (17) individuals with a genotype CC at the AKAP10-1 gene locus and a single heterozygous individual (CT) (as described in Example 2). A target sequence in the AKAP10-1 gene which encodes the C-terminal PKA binding domain was amplified using the polymerase chain reaction. PCR primers were synthesized by OPERON (Alameda, Calif.) using phosphoramidite chemistry. Amplification of the AKAP10-1 target sequence was carried out in individual 50 µl PCR reaction with 25 ng of human genomic DNA templates. Each reaction containing 1×PCR buffer (Qiagen, Valencia, Calif.), 200 µM dNTPs, IU Hotstar Taq polymerase (Qiagen, Valencia, Calif.), 4 mM MgCl2, and 25 pmol of the forward primer containing the universal primer sequence and the target specific sequence 5'-TCC CAA AGT GCT GGA ATT AC-3' (SEQ ID NO: 9), 2 pmol of the reverse primer 5'-GTC CAA TAT ATG CAA ACA GTT G-3' (SEQ ID NO:10). Thermal cycling was performed in 0.2 mL tubes or 96 well plate using an MJ Research Thermal Cycler (MJ Research, Waltham, Mass.) (calculated temperature) with the following cycling parameters: 94° C. for 5 mm; 45 cycles; 94% for 20 sec, 56° C. for 30 sec. 72° C. for 60 sec; 72% for 3 mm. After amplification the amplicons were purified by chromatography (Mo Bio Laboratories (Solana Beach, Calif.).

The sequence of the 18 amplicons, representing the target region, was determined using a standard Sanger cycle sequencing method with 25 nmol of the PCR amplicon, 3.2 µM DNA sequencing primer 5'-GCC ACA GCA GTT AAT CCT TC-3' (SEQ ID NO:11) and chain terminating dRhodamine labeled 2', 3' dideoxynucleotides (PE Biosystems, Foster City, Calif.) using the following cycling parameters: 96% for 15 sec. 25 cycles: 55% for 15 sec, 60° C. for 4 min.

The sequencing products were precipitated by 0.3M NaOAc and ethanol, the precipitate was centrifuged and dried. The pellets were resuspended in deionized formamide and separated on a 5% polyacrylamide gel. The sequence was determined using the "Sequencher" software (Gene Codes, Ann Arbor, Mich.).

The sequence of all 17 of the amplicons which are homozygous for the AKAP10-1 SNP revealed a polymorphism at nucleotide position 152171 (numbering for GenBank Accession No. AC005730 for AKAP10 genomic clone) with A replaced by G. This SNP can also be designated as located at nucleotide 2073 of a cDNA clone of the wildtype AKAP10 (SEQ ID NO:1) (GenBank Accession No. AF037439). This single nucleotide polymorphism was designated as AKAP10-5 (SEQ ID NO:3) and results in a substitution of a valine for an isoleucine residue at amino acid position 646 (SEQ ID NO:4).

EXAMPLE 4

PCR Amplification and MassEXTEND™ Assay Detection of AKAP10-5 in a Healthy Donor Population A healthy population stratified by age is a very efficient and a universal screening tool for morbidity associated genes by allowing for the detection of changes of allelic frequencies in the young compared to the old population. Individual samples of this healthy population base can be pooled to further increase the throughput.

Healthy samples were obtained through the blood bank of San Bernardino, Calif. Both parents of the blood donors were of Caucasian origin. Practically a healthy subject, when human, is defined as human donor who passes blood bank criteria to donate blood for eventual use in the general population. These criteria are as follows: free of detectable viral, bacterial, mycoplasma, and parasitic infections; not anemic; and then further selected based upon a questionnaire regarding history. Thus, a healthy population represents an unbiased population of sufficient health to donate blood according to blood bank criteria, and not further selected for any disease state. Typically such individuals are not taking any medications.

PCR primers were synthesized by OPERON (Alameda, Calif.) using phosphoramidite chemistry. Amplification of the AKAP10 target sequence was carried out in single 50 µl PCR reaction with 100 ng- 1 ug of pooled human genomic DNAs in a 50 µl PCR reaction. Individual DNA concentrations within the pooled samples were present in equal concentration with the final concentration ranging from 1–25 ng. Each reaction contained 1×PCR buffer (Qiagen, Valencia, Calif.), 200 µM dNTPs, 1 U Hotstar Taq polymerase (Qiagen, Valencia, Calif.), 4 mM MgCl$_2$, and 25 pmol of the forward primer containing the universal primer sequence and the target specific sequence 5'-AGCGGATAA CAATTTCACACAGGGAGCTAGCTTGGAAGATTGC-3' (SEQ ID NO:12), 2 pmol of the reverse primer 5'-GTCCAATATATGCAAACAGTTG-3' (SEQ ID NO: 10) and 10 pmol of a biotinylated universal primer complementary to the 5' end of the PCR amplicon BIO:5'-AGCGGATAACAATTTCACACAGG-3' (SEQ ID NO: 7). After an initial round of amplification with the target with the specific forward and reverse primer, the 5' biotinylated universal primer can then hybridize and act as a forward primer thereby introducing a 5' biotin capture moiety into the molecule. The amplification protocol resulted in a 5'-biotinylated double stranded DNA amplicon and dramatically reduces the cost of high throughput genotyping by eliminating the need to 5' biotin label every forward primer used in a genotyping.

Thermal cycling was performed in 0.2 mL tubes or 96 well plate using an MJ Research Thermal Cycler (Waltham, Mass.) (calculated temperature) with the following cycling parameters: 94° C. for 5 min; 45 cycles: 94° C. for 20 sec, 56° C. for 30 sec; 72° C. for 60 sec; 72° C. 3 min.

Immobilization of DNA

The 50 µl PCR reaction was added to 25 µl of streptavidin coated magnetic beads (Dynal, Oslo, Norway) (Lake Success, N.Y.), which were prewashed three times and resuspended in 1M NH$_4$Cl, 0.06M NH$_4$OH. The 5' end of one strand of the double stranded PCR amplicons were allowed to bind to the beads for 15 minutes at room temperature. The beads were then collected with a magnet and the supernatant containing unbound DNA was removed. The hybridized but unbound strand was released from the double stranded amplicons by incubation in 100 mM NaOH and washing of the beads three times with 10 mM Tris pH 8.0.

Genotyping

The identity of the nucleotide present at the polymorphic site of AKAP 10-5 was determined by using the MassEXTEND™ assay and MALDI-TOF (see, U.S. Pat. No. 6,043,031). The MassEXTEND™ assay is a primer extension assay that utilizes a primer that hybridizes adjacent to the polymorphic region and which is extended in the presence of one or more ddNTPs. Extension is stopped by the incorporation of a dideoxy nucleotide. At a polymorphic site the different alleles produce different length extension products, which are distinguishable by mass spectrometry.

The MassEXTEND™ assay detected the sequence of the sense strand and resulted in the incorporation of either T or C into the extension product. The DNA coated magnetic beads were suspended in 26 mM Tris-HCl pH 9.5; 6.5 mM MgCl$_2$ and 50 mM each of dTTPs and 50 mM each of ddCTP, ddATP, ddGTP, 2.5 U of a thermostable DNA polymerase (Amersham Pharmacia Biotech, Piscataway N.J.) and 20 pmol of a template specific oligonucleotide primer 5'-ACTGAGCCIGCTGCATAA-3' (SEQ ID NO:15) (Operon) (Alameda, Calif.). Primer extension occurs with three cycles of oligonucleotide primer hybridization and extension. The extension products were analyzed after denaturation from the template with 50 mM NH$_4$Cl and transfer of 150 nl each sample to a silicon chip preloaded with 150 nl of H3PA (3-hydroxy picolinic acid) (Sigma Aldrich, St. Louis, Mo.) matrix material. The sample material was allowed to crystallize and was analyzed by MALDI-TOF (Bruker Daltonics, Billerica, Mass., PerSeptive, Foster City, Calif.). The primer had a mass of 5483.6 daltons. The allelic variant resulted in the addition of a ddC to the primer to produce an extension product having a mass of 5756.8 daltons. The predominant allele resulted in the addition a T and ddG to the primer giving an extension product with a mass of 6101 daltons.

The frequency of the SNP was measured in a population of age selected healthy individuals. 713 individuals under 40 years of age (360 females, 353 males) and 703 individuals over 60 years of age (322 females, 381 males) were tested for the presence of the SNP, AKAP10-5. Results are presented below in Table 3.

TABLE 4

AKAP10-5 (2073V) frequency comparison in 2 age groups

| | | | <40 | >60 | delta G allele |
|---|---|---|---|---|---|
| Female | Alleles | *G | 38.6 | 34.6 | 4.0 |
| | | *A | 61.4 | 65.4 | |
| | Genotypes | G | 13.9 | 11.8 | 2.1 |
| | | GA | 49.4 | 45.7 | |
| | | A | 36.7 | 42.5 | |
| Male | Alleles | *G | 41.4 | 37.0 | 4.4 |
| | | *A | 58.6 | 63.0 | |
| | Genotypes | G | 18.4 | 10.8 | 7.7 |
| | | GA | 45.9 | 52.5 | |
| | | A | 35.7 | 36.7 | |

TABLE 4-continued

AKAP10-5 (2073V) frequency comparison in 2 age groups

| | | | <40 | >60 | delta G allele |
|---|---|---|---|---|---|
| Total | Alleles | *G | 40.0 | 35.9 | 4.1 |
| | | *A | 60.0 | 64.1 | |
| | Genotypes | G | 16.1 | 11.2 | 4.9 |
| | | GA | 47.7 | 49.4 | |
| | | A | 36.2 | 39.4 | |

The difference in the allelic and the genotype frequencies between the two age groups, for the total population, are significant, p=0.02.

EXAMPLE 5

Discovery of AKAP10-6 and AKAP10-7

Genomic DNA isolation, amplification of the target regions and sequencing of amplicons was carried out as in Example 3. Using the sequence of the cDNA for AKAP10, chromosome 17 was BLAST searched to identify the number of exons. Sanger sequencing of the regions around and containing the exons was performed and resulted in the discovery of AKAP10-6 and AKAP10-7 polymorphic regions. For AKAP10-6 the forward sequencing primer was CCCCAGGGAGTTAGTTTTGC (SEQ ID NO: 21) and the reverse sequencing primer was GATCCACGGTCCTCAAAGAA (SEQ ID NO: 22). For AKAP10-7 the forward sequencing primer was CACTGCACCCAGCCTTATG (SEQ ID NO: 23) and the reverse sequencing primer was CTGGGATGTGAAGGAAAGGA (SEQ ID NO: 24).

EXAMPLE 6

MassEXTEND™ Assay Detection of AKAP10-6 and AKAP10-7

Samples are obtained and amplified as in Example 4.

The identity of the nucleotide present at the polymorphic site of AKAP 10-6 is determined by using the MassEXTEND™ assay and MALDI-TOF (see, U.S. Pat. No. 6,043,031). The MassEXTEND™ assay detected the sequence of the sense strand and resulted in the incorporation of either G or C into the extension product. Reactions are carried out as in Example 4. The template specific oligonucleotide primer is 5'-GCCGCCATATTATCAACAA-3' (SEQ ID NO: 19) (Operon) (Alameda, Calif.). The primer has a mass of 5740.8 daltons. The allelic variant results in the addition of a ddC to the primer to produce an extension product having a mass of 6014.0 daltons. The predominant allele results in the addition of a G and ddC to the primer giving an extension product with a mass of 6343.2 daltons.

The identity of the nucleotide present at the polymorphic site of AKAP 10-7 is determined by using the MassEXTEND™ assay and MALDI-TOF (see, U.S. Pat. No. 6,043,031). The MassEXTEND™ assay detects the sequence of the complementary strand and resulted in the incorporation of either G or A into the extension product. Reactions are carried out as in Example 4. The template specific oligonucleotide primer is 5'-CTCTGCGTCTCAGGTATT-3' (SEQ ID NO: 20). (Operon, Alameda, Calif.). The primer has a mass of 5456.6 daltons. The allelic variant results in the addition of a ddA to the primer to produce an extension product having a mass of 5753.6 daltons. The predominant allele results in the addition of a G and ddA to the primer giving an extension product with a mass of 6083.0 daltons.

Since modifications will be apparent to those of skill in this art, it is intended that this invention be limited only by the scope of the appended claims.

SEQUENCE LISTING (25 sequences)

SEQ ID NO: 1 - DNA, 2363 bp, Homo Sapiens
  CDS (138)...(2126): Wild Type AKAP-10
  ref <308>: DATABASE ACCESSION NUMBER: GenBank AF037439
  ref <309>: DATABASE ENTRY DATE: 1997-12-21
gcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggctgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacaatgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgccgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtgagtgacttggggcaattcatccgggaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccagggagagaatggggagacaatcctaggacttccaccctaatgcagttacctgtagggcataattggatggcacatgatgtttcacacagtgaggagtctttaaaggttaccaa

SEQ ID NO: 2 - protein, 662 aa, Homo Sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTMKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSPTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 3 - DNA, 2363 bp, Homo Sapiens
  CDS (138)...(2126): AKAP-10-5
  allele 2073: Single Nucleotide Polymorphism: A to G
gcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggctgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacaatgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgccgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtgagtgacttggggcaattcatccgggaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacgttatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccagggagagaatggggagacaatcctaggacttccaccctaatgcagttacctgtagggcataattggatggcacatgatgtttcacacagtgaggagtctttaaaggttaccaa

SEQ ID NO: 4 - protein, 662 aa, Homo Sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTMKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSPTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDVMQQAQYDQPLEKSTKL

SEQ ID NO: 5 - DNA, 21 bp, Artificial Sequence
  Oligonucleotide Primer
tctcaatcatgtgcattgagg

SEQ ID NO: 6 - DNA, 43 bp, Artificial Sequence
  Oligonucleotide Primer
agcggataacaatttcacacagggatcacacagccatcagcag

SEQ ID NO: 7 - DNA, 23 bp, Artificial Sequence
  Oligonucleotide Primer
agcggataacaatttcacacagg

SEQ ID NO: 8 - DNA, 19 bp, Artificial Sequence
  Oligonucleotide Primer
ctggcgcccacgtggtcaa

SEQ ID NO: 9 - DNA, 20 bp, Artificial Sequence
  Oligonucleotide Primer
tcccaaagtgctggaattac

SEQ ID NO: 10 - DNA, 21 bp, Artificial Sequence
  Oligonucleotide Primer
gtccaatatatgcaaacagtt

SEQ ID NO: 11 - DNA, 20 bp, Artificial Sequence
  Oligonucleotide Primer
cccacagcagttaatccttc

SEQ ID NO: 12 - DNA, 43 bp, Artificial Sequence
  Oligonucleotide Primer
agcggataacaatttcacacagggagctagcttggaagattgc

SEQ ID NO: 13 - DNA, 162025 bp, Homo Sapien
  allele 83587: Nucleotide sequence of Chromosome 17 with genomic sequence of the allelic variant AKAP10-6
gaattcctatttcaaaagaaacaaatgggccaagtatggtggctcatacctgtaatcccagcactttgggaggccgaggtgagtgggtcacttgaggtcaggagttccaggccagtctggccaacatggtgaaacactgtctctactaaaaatacaaaaattagccgggcgtggtggcgggcacctgtaatcccagctactcaggaggctgaggcaggagaattgcttgaacctgggagatggaggttgcagtgagccgagatcgcgccactgctctccagcctgggtggcagagtgagactctgtctcaaaaagaaacaaagaaataaatgaaacaattttgttcacatatatttcacaaatttgaaatgttaaaggtattatggtcactgatatcctgtttcattctttatataatcattaagtttgaaatgtatacttgcactactaacacagtagttaatcttagtcctacaagttactgcttttacacaatatattttcgtaatatgtatgcactggtgtttatgtacgtgtttatgtttatatctgttaaaattagcagtttccatctttttctattttgtaccatcacatcagttcagaaggattgacagagcaaaatgatttgatgaagtataaaagtcacatggtgagtggcataaatacaactctgaacaattaggaggctcactattgactggaactaaactgcaagccagaaagacacatatcctatatgtcaagagatgtaccacccaggcagttaaagaagggaagtacacatagaaagcacaatggtgaataattaaaaaattggaatttatcagacactggattcatttgctcctaaagtcagagtcctctattgtttttttgtttttgtgggtttctttttaaatttttttattttttgtagagtcggagtctcactgtgttacccgggctggtctagaactcctggcctcaaacaaacctcctgcctcagcttcccaaagcattgggattacagacatgagccactgagcccagcccagacgctttagcatttatgaagcttctgaaatagttgtagaaaccgcataagctttccatgtcactttcaaagtttgatggtctctttagtaaaccaaccaagttattcctcaagggcaaaataacatttctcagtgcaaaactgatgcacttcattaccaaaaggaaaagaccacaactatagaggcgtcattgaaagctgcactcttcagaggccaaaaaaaaaggtacaaacacatactaatggaacattctttagaagagccccaaagttaatgataaacattttcatcaaagagaaaagagaacaaggtgttagcaaattcctctatcaaataacactaaacatcaaggaacatcaatggcatgccatgtggaagaggaagtgctagctcatgtacaaaccagtagataatttcaacttgctgccgaatgaaacctctttgcaaggtatgaatcagcacttctcatgtttgttttgctttgttttgttttgtttttagagacaggcccttgctctgtcacacaggctggagtgcagtggcacgatcagagctcactgcaacctgaaactcctgggctcaagggatcctcctgccttagcctcccaagtagctgggactacaggcccaccatgcccagctaattttttaaattttctatagagatgggatctcactagcacctttcatgtttgatgttcatatacaacgaccaaggtacaatgtggaaaagggtctcagggatctaaagtgaaggaggaccagaaagaaaaggggttgctacatagagtagaagaagttgcacttcatgccagtctacaacactgctgttttcctcagagcagagttgatgatctaaatcaggggtccccaacccccagttcatagcctgttaggaaccgggccacacagcaggaggtgagcaataggcaagcgagcattaccacctgggcttcacctcccgtcagatcagtgatgtcattagattctcataggaccatgaaccctattgtgaactgagcatgcaagggatgtaggttttccgctctttatgagactctaatgccggaagatctgtcactgtcttccatcaccctgagatgggaacatctagttgcaggaaaacaacctcagggctcccattgattctatattacagtgagttgtatcattatttcattctatattacaatgtaataataatagaaataaaggcacaataggccaggcgtggtggctcacacctgtaatcccagcacttcgggaggccaaggcaggcggatcacgaggtcaggagatcgagaccatcctggctaaaacggtgaaaccccgtctactaaaaattcaaaaaaaaattagccgggtgtggtggtgggcacctgtagtcccagctactcgagaggctgaggcaggagaatggtgtgaacctgggaggcagagcttgaggtaagccgagatcacgccactgcactccagcctgggcgacagagcgatactctgtctcaaaaaaaaaaaaaaaaaaaaaagaaataaagtgaacaataaatgtaatgtggctgaatcattccaaaacaatccccccaccccagttcacggaaaaattctcccacaaaaccagtccctggtgccaaaaaggttggggaccgctaatctaaataatctaatcttcattcaatgctaaaaaatgaataaacttttttttaaatacacggtctcactttgttgcccaggctggagtacggtggcatgatcacagctcactgtagcctcaatcacccaggccccagcgatcctcccacctaaacttcctgagtagctgggactacaggcacgcaccaccatgcccagctaatttttaaattttttatagagatgggggtctcaccatgttgcccagactggtctcaaaccctgggctcaagtgatcctccctcaaactcctggactcaagtgatcctccttccttggcctcccaaagtgctgggattacaagcatgagccactgtacccagctggataaacattttaagtcgcactacagtcatggacaatcaggcttttcaacatgcagtatggacagtgagtcccagggtctgcttttccatactgaaatacatgtgatactaaggagaaaggtgctcgcaaggatatttaaaatgaagaatatttaaaatgaggaaaaaactgtttcttcatgactttgataaggctgataaagaccatttctgtgatctcaggtgattcactcaagtagtatatttcagtaatcattatctggaacagcctgaatcttaaccaaaataccatgattttttaatgctgttatgataccttgatgatatgaccaaactgcaatgtaggcagctaaatctccacgagtttgacttccccgagagttgacagttttcttcacaaattaaagaaatatattttttgatacatgattggcatatttaaaaactacactgaaatgctgcaaaatgatataaagaaacattttccagaatcaaatgcaatcaaagagtggattaggaatctactcaccattatcaactaaatagaaacacttggactgggtgtggtggctcacatctgtaatctcagcactttgggaggccaaggcaggtggattgcttgaggccaggagctcaagaccagcctgagcaacatagcaaaactctgtctctacaaaaaaaaaaaaaaattaaccaggcatggtggcagatgcttgtaatcccagctactctggaagctgaagtaggaggactgcttgagcccaggagatcaagactgcagtgagccgtggtcatgctgcgccacagcctgagtgacagagagagaccctgtctcaaaaacaaaaacaaacaaaaaacacttaaccttcctgttttttgctgttgttgttgttgtttgtttgttttgagatggagtctcactctgttgcccaggctggagtgcagtggcgtgatcttggctcactgcaagctctgcctcccgggttcacgccattctcctgcctcagcctcccgagtagctgggactataggcgcccgccaccacgcccggctacttttttgcatttttagtagagatggggtttcaccgtgttagccaggatggtcttgatctcctgacctcgtgatccacctgcctcggcctcccaaagtgctgggattacaggcatgagccaccgcacccggccaacctttctgttttttagtttgatatgcttgttaactcagcagctgaaagaatgctgaaagtggccttcagtaaaaaaatttcactagaatctctacatccatatttaatctgaatgcatatccagattgatcagttagagcaaaaacactcatcatcattcctgatgacctctaattctggtttcggctttctatttcaatggaaacagaataaggaaagaaatggaagggctctggaaatttgtcctgggctatagatactatcaaagatcaccaacaataagatctctcctataaatataaaacaagtataattaattttttaattatttttttctcttcagaggattttatttcaagataaaacataacttctacccatactattgattccaaaggttagaaaaagtgtttttcctcatcttatccttcaaagaggtcacagcaatgcaaacatctataaaatgcctctgcataattgtcagaagctatagtccagaaatcattgaaaatgcttttccattttaagcttaggtgaggtgtcttaggaaacctctatgacaacttactctatttattgggaggtaaactcccagactctcccagggtctcctgtattgatctcattttttaggcttcctaatcccttgaagcacaatcgaaaaagccctggatctcttttctgcacatatcatcgcggaattcattcggcttccagcaagctgacactccatgatacaagcggcctcgcccttctccggacgccagtccttgctgcggttagctaggatgaggggtttgctgggcttcagtgcaggcttctgcgggttcccaagccgcaccaggtggcctcacaggctggatgtcaccattgcacactgagctcctggcaggctgtaccaattttttaattatttaatatttatttttaaaattatggtgaatattttggtattctgctctaaaataggcccataaatgcacagcagatatctcttggaacccacagctttccactggaagaactaagtatttttcttttaaagatgctactaagtctctgaaaagtccagatcctctacctctttccatcccaaactaagacttggaatttatgagagatctagctaacagaaatcccagacacatcattggttcttcccagagtgcagtcctcctaaagaggctcagccctaagcaggcccctgcaccaggagggtgggtctgagacccacatagcacttcccaaggtgcatgctccagagaggcactgaaacagctgagcacaagcctgcaagcctggagaactctcacagtcagaacggagggggcccagtgggactaacataaagagaaaagggaacacagagaaatggatggcaccaacaaccagcaaagccttcatggccaatgaaagcatcagtgacggggccagaaccctcatccccaaagactcttcactgcctttagtgaaaaacaatggctagagagtgaagttatgatcatgtatagagaggtaaagttacatttttatattctgactctgctaatgtgaaattccctatctgctagactaaaagtttcagacaccctgttcaaatatcccattagttgctagagacttaaaatgaacagaacgcacattgtcaggatgactattaccaaaaaatcaaaagacagcaagtattggtgaggatgtagagaaactggaacttttgtgcactgtttatgagaatgtaaaatggagcagctgctgtggaaaagagtatgcaggttcctcaaagagtaaaaccaagatgtggaaacaactaaatgcccatcagtggatgaaggggtagacaatatgtggtatatacataccatggagtactattcagcctctaaaaaaaaaaaaggaaattctataacatgcaacagcatggatgaatcttgaggacattttgctaatgaaataaggcagtcatagaaagacaaatactgcacgactccacttatatgagataccaaaaatagacaaattcatagaatcaaagagtacaatggaggttacctggagctgcagggcgggaaacgaggagttactaatcaacgaacataacgttgcagttaagtaagatgaataagctctcaagatcagctgtacaacactgtacctagagtcaacaataatgtattgtacacttaaaaatttgttaagggtagattaacaaatgtagtagatccacaaatgtggttaagtgttcttaccacagtaaaataaaaaaagaatatcaagcccaggagttcgagactagcctgggtaacatggtgaaaccctgtctctacagaaaatacaaaaattagccagctgtggaggtgcactcctagggaggctgaggtgggaggcttgcttgagcccaggaggtcaaggctgcagtgagccatgattgcaccactgtactccagcccagatgacagagcaagacaccaccccccccaaaaaaagaaaaagaatatcaaacattttaaaagatcagatacgcaagaacaacaacaaaaaagagatgaacagagcatcgaccctcatctagtgggattcttggtctaactgaaaaacagacattgagagacaaacaatgacagtgatgtgatcacagcaattacacaggtatcccctggggactgcagaagaaaggaggaatgcctaactttcagaaaatagagaaagcgtcaaacagttggtgaaagccttccaaaactagagagaactgcacacaccaaatcacagaaagaagaaaagccgtgggagattctgggacccaccggctatttttgatggctgaacaccctgctgcaggagagacaggagctggaaagcatggtgggatgaaacctcaaacagctttgcctgcattgcttaagatgactgggcttgattaactctagtcaatggggacaattcaatcaaagaagaaagatgctcaaattcacattttagaatgattttttatggcagtatggggaatagattaaaagagagtgaagctggaggcaagaaacttgttaagaggcaactgaaacagtctagatgataaataataaactgacagagtgactagaaaaatcagaacaggctgaatcaacagatacctagatgaaaataacaggacttgatcaccagttgtatcttggagaggaaggagttgtttccttgctttccctacgactgggaatacggaaggtttgccgtgtgtattggttatatactggtgtgtagccaatcactgacaaccatttagcagcttaaaacacaaaggcttatctcccagtttctgtgggccaggaatctaagataggcttagctggctggttctggctcagagtttctcaagaggttgcaatcaagatgtcagctggggttgcatcatctgaaggctcaactggggccggagggtccacttccaaggagttcactcacctgcctgacaaggcagtgctggttgttggcaggagatctcaattcattgccaagtgagcctctctatagcattgctggaacatcctccccatctggcagttggcttctctcagcatgagtgatctgagagagagagcaaggaggaagccacagtgttcttcctactcctactcctaacactatggacctactcctaacactctcacttctgccttattccattagttagaaagggaactaagctccacctcttgaaataagaagtgtcaaagaatttgtggatatatttaaaaatcatcacactgtggaagtggatagggggttcaattaatgctgaacttgaaatgcctgagacattcaaatgtccaacaggcaatgaacatacccatagatggtcatgactttagcaagaatagaggaagatcacagaattaaggaggaattgaaaggtaaaagaagtggagtcagattccccctgaaaagtgagccatgaaaggaactttaactattgagttagaggtcagagtaggaaatttcggtggaattcttttttaaagaaaggaaccatataagcatgttttgaggtagagggagaataaatcagtagacagggagaggtaaaaaacataaatgataggggatagttgacaaaggtcttggcagaatcccttacccattgacttggggccaagagagggacacttctttgtttgagggataaggaaaataagaaagaatgggtgctatttagtgtggtcctgtctctagggcaaacgcataggtaacaaactgtgtgtgttaggaatatagatgtgacctcacattgagattctcacctcaaatccattttgttgttacctgtaccttcctaccttctctttttgctacatgcagactgctgttttgtcttcctggcctgttccaggtttcagcattctggcatatctgctaccctgttcccaaacctctctagagtccatgctccttccttggatagtgtttgattgggccacgtatctaagaagtgatgccttcagttaggcctgagaacctcctctatggaaatctccatcagtgaccctgacagacttggtatcttggagatgtcactgctcccagcctgtggtctaggagaatctcagcctgggcctctagtagtatggataaggcgttaaggtatctttgaaccagagtctgtcatattcctcaatgtgggacagataaaacagtggtagtgctggtgtttctgagctagaactctggtttttggtctagattctttgatgtatgacctttcagaggtattaaaatttgttctaatacaatgttcaatacaaatgtagttccttttctgttaggacctcaacaaaacatgaccaactgtagatgaacattaaactatgacaattcatggaaatgaatacagtaatacctgcggttcccccattttagcagtcactatggtgacatttggcacaaatggctatttaagggtgcttttgttaaaacctaccatcttactaggcacatgatattgaaactaatgaaataatggagaaacttcttaaaaacttttaatgaataaagtgatgaagtgataatattttagctgctatttataaagtgactattacaggtcaaacattcttctagggtttttttgttgaagttgtcacatttaatccttaataacccactatgagtcaggtattcttctctcccctttggacagttggggaaatgggggtcagagaggttaggtaatttgctcagggccacacaacctgcatgtagaaaatctgagatttgtacaggaacgtatcaaactctgaagtccatgcttctattttcccatgctgcctttctaataaaaggtaactaatgctactggatgctgcccccaaagtgagtcactttcaccccaccctacttgattttctccataaaactaatcacatcctgacaacttatttattgctgatctcccccactagattataaactcaataaaagcaagatccttgtctgctgaatatcagtacctaaaacgctgtctagcacagagcaagtaattaatatttgttgaatgaacaaataaaggaaaaaaattcaaaggaagaaaaagccctaaaacagatgtttacctaaacatacattttaaaagaaagcatataacaaattcaggacagaatttaaatttgattttttaaagaaataaccaagtgctagctgggcacagtggctcacacctgtaatcctagcactctgggaggccgaggcaggcagatcacttgaggtcaagagttcaagaccagcctggccaacatggtgaaacctgtctctactaaaaatacagaaattatccaggcatggtggcaggtccctgtaaccccagctactcaggaggctgagtcaggagaattgcttgaacccaggaggcagaggttgcagtgggccaagattgcaccactgcactccagcctgagtaacaaagcaagactctgtctgaaggagaaggaaagaaagaaggaaagaaggaaagaaggaaagaaggaaagaaggaaagaaagaaagaaagaaagaaagaaagaaagaaagaaagaaagaaagaaagaaagaaagaaagaaagaaaaagaaagaaagaaagaaagaaccaagtgcttatttgggacctactatgctatgtttttccatgcacgctattttcagtaaagcagttagcaaacttgcaagatcataacaacaaatatatgcttctataactctaaaattgtgctttaagaagttcctctttaccagctcatgtatgcattagttttctaagagttactagtaactttttccctggagaatatccacagccagtttatttaaccaaaggaggatgcttactaacatgaagttatcaaatgtgagcctaagttgggccagttcatgttaatatactccagaacaaaaaccatcctactgtcctctgacaattttacctgaaaattcattttccacattaccaaggagccagggtaggagaatatagaaagaccacccaagaatccttacttctttcagcaaaatcaattcaaagtaggtaactaaacacatgccctaacaatgaatagcagattgtgctcagaagaatgatctacaacatcttactgtgaaggaactactgaaatattccaataagacttctctccaaaatgattttattgaatttgcattttaaaaaatattttaagcctaaattttaaaaggtttgatattggtacatgaatagacaaacagacatggactagaccaagaattaggttcaaacatatacaggaatttaatatacgataaatctagtattccaaaggaaccaacaaatggtgttcagacagcaggataggcatcaggaaaaacacagttgggcaccctaccttactcctaacaccaggagtaactgaaggagcaccaaatatttatttattttaattatagttttaagttctagggtacgtgtgcacaacatgcaggtttattacataggtatacatgtgccatgttggtgaggagcaccaaatatttaaaagaaaaaaattggccaggggcggtggctcacacctgtaatcccagcactttgggaggccaaggtgggcagatcacctgaggtcgggagttcgagaccagcctgagcaacatggagaaaccccatctctactaaaaatacaaaattagccaggcatggtggcacatgcctgtaatcccagctacttgggaggctgaggcaggagaatagctttaatctgggaggcacaggttgcggtgagctgagatattgcactccagcctgggcaacaagagcaaaacttcaactcaaaaaaattaataaataaataaaaataaagaaagaaaagaaaaaaatgaaaatagtataattagcagaagaaaacaccgtagaatcctcggactcttaggatggggaatgcctataatataaaaaccctgaagttataaaagagaaaatcacctacatacaaaccaaatctttctacatgcctaaaacatagcacaaacacagctaaataatcatagctgaatgaactgggaaaacaaaacttgactcatatccagacagagttaattttcctacacataaagagtacctatataaacccaacaaaaaaaccaccactaacccaaaataaaaatgtgacaggtaatgaacaggtagttcacagagaatacaaatggctcttcggcacataagatgctcagactgacttttacttatttattttttgagagacagggtctcacgatgttgcccaggttaggctcaaactcctgggctcaaatgatagtaccaggactacaggtgtgccccaccgcacctggctcctcaaccacctgtattaacaggaaatgcaaaataaaactttcaaatctattttacctattagaatggcaaaaatttgaaaaacttcaaacatcatcatgttggtgagaatgtgaggagactggcactctcattttttgctgatagcatatatatactgatggcttctatggaaagcaatctggcagcgtctatcaaatgtacaagtgcatatatcctttgacaaagcaattccactctaggaatgtgttctatatggttgtgcttcctggggctgggaactgggagctaagggacaggggcagaagataatcttcttttccctccttccccgttaaacatgttgaattttatatactgtaatatattatttttcacaaaagataatttttaagcgatatgtctgggaatttttttttttcttttctgagacagggtctcactctgtcatccaggctggaatgccatggtatgatctcagctgactgcagcctcgacctcctgggttcaagcaatcctcccacctcagcctcctgagtagctgggactacaggcacgtgccatcatgctaatttttgtatatacagggtctcactatgttgcccaggctaatgtcaaactcctaggctcaagcaatccacccacctcaggctccaaagtgctgggattacaggcgtgagccaccgcgcctggccctgggaattcttacaaaagaaaaaatatctactctccccttctattaaagtcaaaacagagaaggaaattcaacctataatgaaagtagagaagggcctcaaccctgagcaacaaacacaaaggctatttctgagacaggaatttgctgaacaaaatcgagggaagatgacaagaatcaagactcacttctcggctgggcgcagtggctcacacctgtaatcccagcactttgggaggccgaggcggacagatcacgaggtcaggagattgagaccatactggctaacacagtgaaacccagtctctactaaaaatacaaaaaattagccgggcgtggtggcaggtgcctgtagtcccagctacttgggaagctgaggcaggagaatggcgtgaacccaggaagcggagcttgcagtgagccgagatcacgccactgcactccagcctgggtgacagagcaagactctgtctcaaaaaaaaaaaaaaagactcatttctctagatcttgagccgtattcaaatttatctcagcttagtgagaggttaaagcaaggaatatccttccctgtgggccctgctccttactgaaggaaggtaacggatgagtcaaggacaccaatggagaaaagcactaacaccattatctgatgaacattacgtgaagaagggtaagaagtgaagtggaattgctgaagaagtcagtgaaagcggacattcatttggggaaatggaatataggaaatccataaaagtgattaaaaagatgttagaggctgaggcggggggaccacagggtcaggagatcgagaccatcctggctaacacggtgaaaccccatctctactaaaaatacaaaaaattagccaggcgtggtggcaggcacctgtagtcccaactactcgggagactgaggcaggagaatggcatgaacctgggagacggagcttgcagtgagccgagatcacgccactgcactccagcctgggtgacagagtgagactccatctcaaaaaaaaaagttagatacgagagataaagatccaacagacacacaactgctaattctgaacagaacaaaacaaatggcacaggaaaagaaaatttaagatataacaccggaaaactttcctgaaattgagtaactgaatctatagcttgaaagggtttagcatatgccaagaaaaatcagtagagtccaaccagcacaagacacatctagcaaggctggtgattctaccaacacagagaaagaagtgggtgacccataatgcggaaaaaggcagaccatctgcagtcttctccagaacactggagtctgaagacaaaagaatgctgcctactgagccagaagggagagaaagtgacccaacacatctttaccaagttagaatgtcacgcattatttaaaggctgcaaaagccatgaaagacatgaaagaacacaagcatttacaacatgaaagaacacaagcattctcatactcaagaatccttaagaaaaatgtagtcctaatccagcccactgaaagttaaatgtacttaatgtgctcattaatgggaacttcatagcttcaaatcagtctggtcccatctaccaacatctctcgcccggctttcctgcaatagtcagcacctttccctcctcccagtcttgtcccctggagtctgctctcagcatagcagagtgaccacatcaacacccaagtcagagccctccagtgcgcactggtctacaaagcccttcccaccccccaccccacgtgccctccggatccttgtgacgtgtctcctgcataccctagcagccctggcctcctcactgcccctcctgtacatcaggaaggcgactccttgagtcttggctctggccgcctcctccacctgcagtgagttaactcccttacctactctaggtcattgctcaaatgtcagcatctcaatggggccctccctgactaccctatttaaattctacatactccccttgaccccatggacctcactcaccctattccacttttattcttacaatttagcacttgttctcttctaacgtattctaagacttactcatttattacattgtttgccaccccctctagtacataaactccagaggggcagggatttctgtctatttattcatttctttatccctaggacatagaacagggcatagttcagagtattcaatgttatcaatgaatgaactagcagtagtaccagttccagttaggcacagaattaaatctaaatagaattaaatctcatggtctgggttaactatggatagaaaattagatataattttaagaagcctagaaagaaaaaattaataatgtaaaaataatattaatttgataataataacaaaaactctgccaggcactgtggctcaaatctgcaatcccagctactcaggaggctgaggtggaaggatcacttgagaccagagttcaagactcagcctaggcaacacggcaagaaactgtctctaaaaaaattaaaacttaaatttttaaaaaagaattctcaaagcgtcacaaaaactggagattaaggtacaggaagtgtgaagtaatattactatgctaatggttttttttttttttagaaaggtataaccaaaagatttctttctcaagtcgataaactgagaaagataagcatatcttccaattaacagagggggaggaaaagccagatacaacaaaataagatataaattagtttccagttgaaaacaagagtaggagttattttgcatcacctcacctgtgacctcccccagcccaaaaaacactactgataaacagggtagaaaagcatcatctcagataaagcaggaaaaactgccacagtctcaaaccacaaactataagcacacacctggccaaccctgccaagtctgggctcagtaggaggaacgtgctgagagctaggatgtaccaacttagacattctgtgggatacagatgtccctggaagggtcacaccatctcaaaggcacctgtaatgcccactgattacagccaccatatgtgagagagaaactcagggcacttagagagtataacaagaaccttatgtcatctgagatgaggaatcctcagccctgcaaattaaccaactctttagaacaactggcaaaacataaatatccacaacttttgtttcagtaattccactcttagatatcaatccaaagtacatgagacagcagatacacacacaaaatggtatttactgcagcattgtttataatagcaaaaaacaagaaataatccatatgtctcaataggatactgggtacatgagggtatgtacccatcattcaaccatcaaaaagagtgatatggatgtccacagatggacataaaaagctgtgtgttacgtgaaaacaaactcaagcagcagcaggatgggcttatgatagtcagtatgagctaatttctggaaaaaaaaatctagtgtgtgcacagaaaacatctgaaagaacagaaacaaaactatcagcagaatattgagatgttttactaagttgtatatctatactgcttgtaatttttaccccaagcaagaattactttttggaaaaagaaaattcaggaaataaagcatttctttaaacttcatgtttaaacaaatggtgatggaataaaagagttcttattcatcataaacacacacagcacacatgcacgcatgtgcgtgagcacaccctttacttgataaataccatgttgaatattttagtctttccttttaggttctatcccttcactcaaaatgcggttataaataaatgtacttttcatgtgccttctgcctaaacccactttaatataactttacagtcccattatcattatagtctcaaagctagactcagcctgaaactaccctttcatttggaacccttattaaaatgccacatacagctccttcaaataaaaacaaaccctaggacctgacactaggcttcctttgttgctactcataatggccaagttctgtgcttataatacatcttctttcattttattgctacatatccaagggttttatatgtttttcttattatatcttaattcaaaacaccatcacgctcttttccagatgaaaataaggaaaagaaattgagcaactgactgacttaaaggtcataaaactatatagtagcagagtcagcaaaagaagaaacacacatctcccaagtagaggctgaaaaccagtaccattcacctccagggtgagctatatacagattacaaagtcaccttctctaaatgttcaaactgaatcccatacccatactttaccactacctcgtaagaacagcctcagatcttgttatagccttttttttagcatgctgaagccaataaaatgcttcccattcagcaagagaaacaagttctgaaacactgaataatctgcccagggcctatgaacatttccactgtgagaaatgttctccactgtgtggagaagatccttactcttctccacacaggcagaacattagaaaaattcttggattctatgatgcacagcttaggagtctgtttagcacaatttaagtccaaatagttattaaatcctcctctgttccagaaacagtgctaaatactgtgaatataaaaattgaaaagatactctcctggctcccaagaaagtcagccagatagaggagacacaggcacacaaatcactgtcacatgaagctctacctccctaacttcaaacgagggcctaagtcaccaagaatacagtagcagttgtgactacgagtaactactataattcaatactttatcttcccttagaaaactcttctcccttggaaatttatttgcatttctaaataccattccttactaaaaggaagcagggctccttggggaaatagctgattctaggtgtggactatgaaatgaaaatggtgagtctgggacatcccatgttgcccagaaatcaaggaactgcccaaagattaacagagtcatgttaaatggacctaagagtgaaccagaaggagctcactttgccccgcgtggaacaatttcaagaaaaacatgacagtaatgaattataaaacatgaattaaaatacatattggtactaaaaagagaacaaaaggatgtggctttggataaagctcttcttcatggaagaataccagctaataaatgtaaaggaaatgagagaattagaaaaattatcattttgtaaaccttaatatattcacctagacatgctaaaaccactgagtaaaaggctgcttgggaagaggatgctcacatgatctcagagtttcacaccacagataatttattagatacaggaaggaagatgtgatcaagcttcctgtgacccccagccaggccccacaacactatgtgcctccttgtgatgtgggagctacacagcatcgcccacacagcttctcgccaaaactgtttgaagctaatcacaagggaagaactggacagcttctgaccatgagacgctccaccagacaacttgcttggcctctccaaagaaacttgcttggcctctccaaagaaaactcagtttcatttaaaaacaaaactaattatttaaaaacaaacgaaaagcaagttgtggacttgagctccagggacagagcagacatacttttccctgttcttcccagtaagtggtaataaaaaccctcaacactagatataaaacaaatataagaaggttctggaaggggaagaggaggcagactatccaggtgccttgaggcccacagaacaacccagtgatgggttcactgggtcttctttttgcttcattatctcagacttggagctgaagcagcaggcaacttcaaaacaccaaggggcacagattgaaaagccccaagaaaagcctgccctctctagccaaaggaccaggaaggagacagtctaatgagatggaacacatttagacagtaactgcccatttaccagcaataactgagcagggagcctagacttccagtcttgtgaggacgtaccaaggtacccaacacccccaccaaggctgagtaaggactgcgacttttatccctgcatggcagtagtaaggagcccatccctcacccgccagcagtgtcaggggaacctggacttccactcccacccaggagtgatgaggccctccctgctggggtcatgtcagaggaggcctagtggagattcagtgacttaaccttttcccagagataatgaggccacctttcctccctcttcccccatggtgacagtgaaagcactgtggcaagcagtaggcactcctacccctcctagccagggaggtatcagggaggccaagtagggaaccagaatacccacaaccacccagcagcaacaggggtcccccaccccattgggtgtcaatggaagcagagcggaaagcctggatatttacccccatctagaagtaacaagctgatgtcccccttcttctactacaatggtgttcaaaacaggtttaaataaggtctagagtctgataacgtaatacccaaatcgttgaagttttcattgaggatcatttataccaagagtcaggaagatcccaaactgaaagagagaaaagacaattgacagacactagcactaagagagcacagatattagaactacctgaaaggatgttaaagcacatatcataagcctcaacaggctgggcgcggtggctcacgcctgtaaccccagcactttgggaggccgaggcaggtggatcacaagatcaggagatcgagaccatcctggctaacacggtgaaaccccgtctctactaaaaatacaaaaaaaaatagcaaggcatggtggtgggcacctgtagtcccagctactcgggagcctgaggcaggagaatggcatgaacctgggaagaggagcagtgagccgagatcgcaccaccgcactccagcctgggcaacagagcaagacttcgtcccaaaaaaaaaaaaaaaaaaaaaaaaagcctcaacaaacaactacaaacgtgcttgaaacaaatgaaaaaaaaatcttggcaaagaaataaaagatatatattttggccaggtgcagtggctcacagcctgtaatccctgcactttgggaggctgaggcaggcggatcacctgaggtcaggagtttgagaccagcctgaccaacatggagaaaccccgtctctactaaaaatacaaaattagccagtcatggtggcacatgcctgtaatcctagctactcaggaggccgaggcaggagaatcgcttgaactcaggaggtggaggttgcggtgagccgagatcccgccattgcacattgcactccagcctgggcaacaagagcaaaactccatctcaaaaaaatagatacatattttaatggaaattttagaattgaaaaatacagtaaccaaattgaatggaaagacaacatagaatggagggggcagacaaaataatcagtgaacttcaacagaaaataatagaaattacccaatatgaagaacagaaagaaaatagactggccaaaaaataaagaagaaaaaagaggagcagcaggaggaatgatggaaaaagagaaaggaaggaaggaagggaaggagggagggaaggagtgagggagaaagtctcaaagacctctgagactaaaataaaagatctaacacttgtcatcagggtccaggaaagagacaaagatggcacagctggaaacgtattcaaaaaataatagctgaaaacttcccaaatttggcaagagacataaacctatagattcgaaatgctgaaccccaaataaaaagcccaataaaatccacaccaaaatacatcatagtcaaacttctgaaaagacgaaaagagaaaacgtcttgaaagcagtgagtgaaacaacacttcatgtataagggaaaaacaattcaagtaacagatttcttacagaaattaaggaagccagaaggaaatgacacaatggttttcaagtgctgaaagaaaagaagtgtcaacacaaaattctagattcagtaaaaatatccttcaagaatcaatgggaaatcaagacagtctcagataaagcaaaataagagaatatgttgccagcagatctcccctaaaggaatggcaaaaggaagatcatgcaacagaccaaaaaatgatgaaagaaggaatccagaaacatcaagaagaaagaaataacatagtaagcaaaaatacatgtaattacaataaaatttctatctcctcttaagacttctaaattatattgatggttgaagcaaaaattataaccctgtctgaagtgcttctactaaatgtatgcagagaattataaatggggaaagtataggtttctatacctcattgaagtggtaaaatgacaacactgtgaaaagttacatacacacacacacgtaagtatatataaatatatgtgtgtatatgtgtgtgtatatatatatatacatataatgtaatacagcaaccactaacaacactatacaaagagataataaccaaaaacaatttagataaattgaaatggaattctaaaaaatattcaaatactctacaggaagacaagacaaaaagagaaaaaaagaggaggacaaactaaattttttaaaaacataaataaaatggtagacttaagccctaacttatcaataattacataaatgtaaatgatctaattatatcaattaaaagacagagatagcagagttaatttaaaaacatagctataagaaacctgctttgggctgagtgcagtgactcacacttgtaatcccagcacttcgggaggccaaggcgggtggatcacctgaggtcaggagttccagaccagcctggacaacatggtaataccccatctctactaaaaatacaaaaaaattagccaggcatggtggcacacgcctgtagtcccaactactcaggaggctgcgacacaagaactgcttgaacccgggcagcagaggtagcagtgggccaagattgcgccactccagcctgaacgacagagtgagactccacctcagttgaaaaacaaaaaagaaacctgctttaaatataccaacatatgttggttgaaattaaaagaataaaatatatcatgaaaacattaatcaaaagaaaggagtggctatattaataacataaaatagacttcagagaaaagaaaatttcaagagacaggaataaaaggatcaagaaaagatcctgaaagaaaagcaggcaaatcaatcattctgcttggagattcaacaccctctcttaacaactgatagaacaactagacaaaaaaatcagcatggagttgagaagaacttaacaccactgaacaacaggatctaatagacatttacggaacactctacccaacaatagcaaaataaacattcttttcaagtattcactgaacatatccttagaccctaccctgggccataaaacaaagctcactagtgattgccgaaggcttggatggacagtggaagagctgcatggggagggagaaggtgacagttaaagagtgtaggatttctttttgggataatgaaaatgttccaaaattgattgtggtgatgttggcgcaactctacaaatataaaaaaggccattgaattgtacgttttaagtgggtgaaacatatggtatgtggattatatctaacgctttttaaaaacttaacacatttcaaagaatagaagtcatacagagtgtgctctactggaatcaaactagaaagaggtaactggaggataacgagaaaagcctccaaatacttgaaaactggacagcacatttctaaaatcatccgtgggtcaaagatattcatttctgatattcatttttattgtttaatgtatttttaaaaatttcttaagggaaataaactgactaaaaatgaatatggctgggtgcggtggctcacgcctgtgatcccagcactttgggaggccgaggctggtggatcacaagatcaggagttcgagaccagcctggccaagatggtgaaaccccgtctcaactaaaaaactacaaaaagtagccaagcgcagtggcgggagcctgtggtcccagctacttgggaggctgaggtaggagaatcgcttgaacacaggcagcagaggttgcagtgagccaagattgtgccactgcacgccagcctgggcgacagagactgcctcaaaaaaaaaaaaaaaaaaaagaatatcaaaatttgtgggacatagttaaagcaatgctgagagggaaatttataacactaaatgtttacattagaaaagagaaaaagtttcaaatcaatagtctccactcccatctcaagaacacagaagatgaagagcaaaataaacccaaagcaagcaaaagaaagaaaatataaaaataaatcagtaaaattgaaaacagaaacacaataaagaaaatcagtgaaacaaagtactgattcttcgaaagattaataaaattgacaaacctctagcaaggctaacaaacaaaaaagaaagaagacacggattaccagttattagaatgaaagcataattagaaacaactctacacattataaatttgacaatgtagatgaaatggactaattactgaaaaaacacaaattaccacaactcacccaatatgaaatagataattgggatagcctgataactactgagaaaattgaatttgtaattttaacactcttaaaacagaaacattaaacttaatattttataaatattagataaggtaattatacccttccttaacaaataaaaacgacaaattattttgcagctaaagagatgtatgtactgtgaaaaatatcttcagaaaaatagaactttgtttgaagaataaggatttaaaaaatgtttttaactctcaagaagcaaatatctgggcccagatggtttcactgaagaattctaccaaatgtttaatgaagaattaccaccaactctacatagcatctttgagaaaactgaagagaagggaacatctcccagttcattttatgaagtgggtgttactctgatactagaactgtataaggacagctactcttgacacactgcctatgggtagctctgctctgcaggaacagtcagaaaaaaaaaaaaaagaagcactggacaagggcagtataaaaaaagaaaactgggccaggtgcagtggctcacacctgtaatctcagcactttgggaggctgacgctggtggatcacctgaggtcaggagtttgagactagcctggccaacatggtaaaaccctgtctctactaaaatacaaaaattagccaggcagggtggtggggaaaataaaaaggaaaaaaaaacaaaaataaactgcagaccaatatccttcatgagtatagacacaaaactccttaaactccttaacaaaatattagcaagtagaagcaatatataaaaataattatacaccatgatcaagtgggacttattccagaaacgcaagtctggttcaacatttgaaaacaaggtaacccactatatgaacgtactaaagaggaaaactacataatcacatcaatcaatgcagaaaaaagcatttgccaaaatccaatatccattcatgatactctaataagaaaaataagaataaaggggaaattccttgacttgataaagcttacaaaagactacaaaagcttacagctaacctatacttaatggtgaaaaactaaatgctttcccctacgatcaggaacaaagcaaggatgttcactctcattgctcttatttaacatagccctgaagttctaacttgtgcaaaacgataagaaagggaaatgaaagacctgcagattggcaaagaagaaataaaactgttcctgtttgcagatgacatgattgtctcatagaaaatgtaaagcaactaggggtaggggggcagtggagacacgctggtcaaaggataccaaatttcagttaggaggagtaagttcaagatacctattgcacaacatggtaactatacttaatatattgtattcttgaaaatactaaaagagtgggtgttaagcgttctcaccacaaaaatgataactatgtgaagtaatgcatacgttaattagcacaacgtatattactccaaaacatcatgttgtacatgataaatacacacaattttatctgtcagtttaaaaacacatgattttggccaggcacagtggctcatacctgtaatcccagcattttaggaggctgaggcgagcagaaaacttgaggtcgggagtttgagaccagaatggtcaacatagtgaaatcccgtctccactaataatacaaaaattagcaggatgtggtggcgtgcacctgtagacccagctacttgggaggctgaggcacgagaattgcttgaacaagggaggcagaggttgcagtgagctgggtgccactgcattccagcctggtgacagagtgagactccatctcaaaaaaaataaaataaagcatgacttttcttaaatgcaaagcagccaagcgcagtggctcatgcctgtaatcccaccactttgggaggccgaggcaggcagatcacaaggtcaggagtttgagaccagcctgaccaacatggtgaaaccccatctctactaaaaaatatataaattagccaggcatgtgtagtctcagctactcaggaggctgaggcaggagaatcacttgaacccggaggcagaggttgcagtgttgagccaccgcactccagcctgggtgagagaacgagactccgtctcaaaaaaaaaaagcaaaataacctaattttaaaaacactaaaactactaagtgaattcagtaagtctttaggattcaggatatatgatgaacatacaaaaatcaattgagctggacaaaggaggattgttttaggtcagtagtttgaggctgtaatgcacaatgattgtgcctgtgaatagctgctgtgctccagcctgagcagcataatgagaccacatctctatttaaaaaaaaaaaaattgtatctctatgtactagcaataagcacatgggtactaaaattaaaaacataataaatactgtttttaattgcctgaaaaaaatgaaatacttacatataaatctaacaaaatgtgcaggacttgtgtgctgaaaactacaaaacgctgataaaagaaatcaaagaagacttaaatagcgtgaaatataccatgcttataggttggaaaacttaatatagtaaagatgccaattttatccaaattattacacaggataacattattactaccaaaatcccagaaaaattttacatagatatagacaagatcatacaaaaatgtatacggaaatatgcaaaggaactagagtagctaaaacaaatttgaaaaagaaaaataaagtgggaagaatcagtctatccagtttcaagacttacatagctacagtaatcaagactgtgatattgacagagggacagctatagatcaatgcaaccaaatagagaactaagaaagaagcacacacaaatatgcccaaatgatttctgacaaaggtgttaaaacacttcaacgggggaagatatgtctctcattaaagggtgtagagtcattgcacatctataggcaaaaagatgaacctgaacctcacaccctacagaaaaattaactcaaaatgactcaaggactaaacataagatatacatctataaaacatttagaaaaaggccacgcacggtggctcacgctcgtaatcccagcactttgggaggccaaggcaggtggatcacctaaggtcaggagtttgagaccagccggatcaacatggagaagccccatctctactaaaaatacaaaattagctggacgtggtggcacatgcctgtaatcccagctacttgggaggctgaggcatgagaatcgcttgaacccggggggcagaggttgcggtgagccaagatcacaccattgcactccagcctgggcaacaagagcaaaactccaactcaaaaaaaaaaaaaaaaaggaaaaatagaaaatctttgggatgtaaggcgaggtaaagaattcttacacttgatgccaaactaagatctataaggccagtcgtggtggctcatgcctgtaattccagcactttggtcaactagatgaaaggtatatgggaattcactgtattattctttcaacttttctgtaggtttgacatttttttagtaaaaaattgggggaaagacctgacgcagtggctcacacctgtaatcccagcactttgggaggccggggcaggtggatcacacggtcaggagttcgagaccagcctggccaacatggtgaaaccccgtctctaccaaaaatataaaaaattagccgggtgtcatggtgcatgcctgtaatcccagctactgaggaggctgaggcaggagaatcacttgaacctgggaggtggaagttgcagtgagccgagattgtgccactgcactccagccttgggtgacagagcgagactccgtctcaaaagaaaaaaaaaaaaaagaatatcaaacgcttactttagaaactatttaaaggagccagaatttaattgtattagtatttagagcaatttttatgctccatggcattgttaaatagagcaaccagctaacaattagtggagttcaacagctgttaaatttgctaactgtttaggaagagagccctatcaatatcactgtcatttgaggctgacaataagcacacccaaagctgtacctccttgaggagcaacataaggggtttaaccctgttagggtgttaatggtttggatatggtttgtttggccccaccgagtctcatgttgaaatttgttccccagtactggaggtggggccttattggaaggtgtctgagtcatgggggtggcatatccctcctgaatggtttggtgccattcttgcaggaatgagtgagttcttactcttagttcccacaacaactggttattaaaaacagcctggcactttcccccatctctcgcttcctctctcaccatgtgatctcactggttccccttccctttatgcaatgagtggaagcagcctgaagccctcgccagaagcagatagtgatgccatgcttcttgtacagcctacaaaaccatgagcccaataaaccttttttctttataaattatccagcctcaggtattcctttatagcaagacaaatgaaccaagacagggggaaatcaacttcattaaaataatctatgcagtcactaaacaaataagaacaagaggctccagaagtgggaagccaatacccagagttcctacaatacagtatctgaaaagtccagtttccaaccaaaaaatatatatatacaggccggacatggtagcttatgtctgtaatcccagcactttgggatgctgaggcgggcagatcaccctaggtcaggagttcgagaccagcctggccaatatggcaaaaccccgtctctactaaaaatacaaaaattagccaggcatggtggtggatgcctgtaatcccagctactcgggaggctgaggcagggaatcacttgaacccaggaggcagaggttgcagtgagccgagatcacgccactgaactccagcctgggcaacaaagtgagactccacctcaaaaaaaaaaaaaatatacatatatatatgtgtgtgtgtgtgtgtgcgcgcgtgtgtgtatatacacatacacatatatacatatatacagacacacatatatatatgaagcatgaaaagaaacaaggaagtatgaaccatactttctgtggttatgataggatggggtatcacgggggaagtagacaagggaaactgcaagtgagagcaaacagttatcagatttaacagaaaaagactttggagtaaccattataaatatgtccacagaattaaagaaaagcgtgattaaaaaaggaaaggaaagtatcataacaatattactccaaatagagaatatcaataaaggcatagaaattataaaatataatacaatggaaattccggagttgaaaggtagaataactaaaatttaaaattcactagagaaggttcaacactatatttgaactggcagaagaaaaatttagtgagacaaatatacttcaatagacattattcaaatgaaaaataaaaagaaaaaagaatgaagaaaaataaacagaatctcagcaaaatgtggcacaccattaatcacattaacatatgcatactgagagtaccggaagcagatgagaaagaggaagaaaaaatattcaaatgatggccagtaacttcctagatttttgttttaaagcaataacctatacaatcaagaaactcaatgaattccaagtaggataaatacaaaaagaaccacaaacagatacaccatggtaaaaatgctgtaagtcaaaaacagagaaaatattgaaagcagctagaggaaaacttataagagaacctcacttacaaaagaacatcacttataaaagaaccacaataatagaaacagttgacctctcatcagaaacaatgaatgataacatatttgaagtgctcaaagaaaaaaaataaagattcctatatacgacaaagctgtctttcaaaaatatacatccaaaaggattgaaaccagggtcttgaagagttatttgtacatccatgttcatagcagcattattcacaatagccaaaaggtagaagcaacccaagggtccatcgacaaataaataaaatgtggtatatgtatacacaatggaatttattcagtattaaaaaggaatgaaattctgacacatgctacaacatggctaaaccttgagaacactatgctaagtgaaataagccagccacaaaaggacaaataccatattacttcacttgtatgaaatacctagggtagtcaaattcagagatagaaagtaaaacagtggttgccaagggctgagggagggagtaacgtggagttattgttgaatgggtacagaatttcagttttgcaagataaaaagagttctggagacagatggtggtgagggtggtacaacaatacaaatatactttatactactgaacagtatacttaaaaatgattaacatggtgaaaccccgtctctactaaaaatacaaaaaaattagctgggtgtggtggcgggcacctgtaatcccagctacttgggaggctgaggcagcagaattgcttgaaaccagaaggcggaggttgcagtgagctgagattgcgccaccgcactctagcctgggcaataagagcaaaactccgtctcaaaaaataaaaaataaaaaaaatttaaaaatgattaagcaggaggccaggcacggtggctcacacctataatgccagcactttgggaggccgaggcaggcgatcacttgagaccaggagtttgagaccagcctggccaacatggcaaaaccctgtctctgctaaaaatacaaaaattagccaggcatggtggcatatacttataatcccagctactggtgagactgagacacgagaattgcttgaacccaggaggcagagattgcagtgagtcgagatcgcgccactgaattccagcctgggcgacagagcaagattctgtctcgaaaaaacaaaaacaaaaacaaaaagcaaaaccaaaaaataattaagcaggaaacgagattgctgctgaggaggagaaagatgtgcaggaccaaggctcatgagagcacaaaacttttcaaaaaatgtttaatgattaaaatggtaaattttatatgtatcttaccacaaaaaaaagggctggggggcaggaaatgaaggtgaaataaagacatcccagagaaacaaaagtagagaatttgttgccttagaagaaacaccacaggaagttcttcaggctgaaaacaagtgaccccagagggtaatctgaattctcacagaaaattgaagcatagcagtaaaggttattctgtaactatgacactaacaatgcatattttttcctttcttctctgaaatgatttaaaaagcaattgcataaaatattatatataaagcctattgttgaacctataacatatatagaaatatacttgtaatatatttgcaaataactgcacaaaagagagttggaacaaagctgttactaggctaaagaaattactacagatagtaaagtaatataacagggaacttaaaaataaaattttaaaaaatttaaaaataataattacaacaataatatggttgggtttgtaatattaatagacataatacaaaaataccacaaaaagggaagaagacaatagaactacataggaataacattttggtatctaactagaattaaattataaatatgaagtatattctggtaagttaagacacacatgttaaaccctagatactaaaaagtaactcacataaatacagtaaaaaaataaataaaataattaaaatgtttgtattagtttcctcagggtacagtaacaaactaccacaaattgagtggcttaacacaacttaaatgtattttctcccagttctggaggctaaacacctgcaatcaaggtgagtacagggccatgctccctgtgaaggctctaggaaagaatcctcccttgtctcttccagcttccagtggttctcagtaaccctaagtgctccttggcttgtagctatatcattcctagcaaccagaaagaagaaaataataaagattatggcaaaaaataatgaaatcaaaaggagaaaaatggaaaaaaataaataaaaccaaaagctagttctttgaaaagatcaaccaagttaacaaaccttttaactagactgacaaaaaggaggtaagactcaaattactagaatcagaaataaaagaggggacattactaatgagggattagaaaagaatactacgaacaaatgtgtgccaacaaattagaaaacttagatgaaatggacaggttcctaggacaacatcaactaccaaaatttactcaagaagaaagagacaatttgaatgagctataacaagggaagagactgaattgacaaccaagaaactatccacaaagaaaatcccaggcccagaagatttcactgtgaaattctttcaaacttataaatataaattaacatcagttcttcacaaactcctccaaaaaaaagaacagatctctatttacaggcgatacgatctttagaaaatcctaagggaactactaagacactatgataactgataaacaagttcagcaaggctgcaggatagaaaaccaatatacaaaaatctattatatttctatacacttgcagtgaacaacccaaaaatgagattaagaaaataattcaatttacaataacatcaaaaagaataaaaacactcaaaaataaatttattcaagtaagtgcaaaacttatactctagaagctacaaaacactgttaaaagaaattaaaggtttacataaatgaaaaactatcccatgttcatggatcaaaagacttattactggcaatgctctccaaattgatctataaattcaacaaaatccttatcaaaatcccagatgaggctgggggtggcggttcatgcctgtaatcccagcactttgggaggctgaggcacgcagattacctgaggtcgggagctcgagatcagcctgaccaacatggagaaaccctatctcttctaaaaatacaaaattagtcaggcgtggtggcacatgcctataatcccagctactcgggaagctgaggcaggagaatcgcttgaacccaggaggcagaggttgcagtgagccaagatcgtgccattgcactccagcctgggcaacaagagcaaaattccatctcaaaaaaaaaaaaaaaaaaatcccagatgacttcactgttgaaattgaaaagattattctaaaattcacatggaattgcaagaccttgagaatagccaaaacaaacttgaaaaacacgaacaaaatataggatgactcacttgccaattgcaaatgttacgacacagcaacagtaatcaagactgtgtggtactggcaaaagacacatacatacatacatatcaatggaatataattgagagtacagaaacaagcctaaacatctatggtaagtgcttttctatttttttctttttttttttcttttttgtagagatagaatctcaccatgttgcccaggctggtcttcaacttctgggctcaagcaatcctcccactgtggcctcccaaagtgctgggataactggcatgagccaccacatccagcccagatgattttcaaaaaagtcaacaagaccattcttttcaacaaataggtctgggatgatcagatagtcacatgaaaaaaaaaatgaagttggaccctccatcacactaaagtgctgcgattataggcatcagccaccacatccagcccaaatgattttcaaaaaggtcaacaagaccattcttttcaacaaataggtctgggataatcagatagtcacatgaaaaaaaaaatgaagttggaccctccatcacaccatatgcaaaaattaattcaaaaatgaattgatgacttaaacgtaagagttacgactgtaaaactcttagaaggaaacatacgggtaaatcttaaagacgttaggtttgacaaagaattcttagacatgacaccaaaagcatgaccaactaaggtaaaatagggtaaattgtacctaccaaaatgaaaaacctttgtgctggaaaggacaccatcaagaaatggaaagccaaaatagccaaggcaatattaagcaaaaagaacaaagctggaggcatcatactacctgacttcaaagcaacagtaaccaaaacagcatggtactagtagaaaaacagacacatagaccaatggaacagaataaagaacccaaaaataaatccacatatttatagtcaactgatttttgacaatgacaccccttcaataaatgatactaggaaaactggatatcgatatgcagaagaataaaactagacccctatctctcaccatatagaaaaatcaactcagactgaattaaagacttgaatgtaagacccaaaactataaaactactggtagaaaacataaggaaaaacgcttcaggacattggtccaggcaaagatcttatggctaaaacctcaaaaacacaggcaacaaaaacaaaaatggaaaaatagcactttattaaactaaaaagctcctgcacagcaaaggaaacaacagaatgaaaagacaacctgtagaatgggagaaaatatttgcaaactatccatccatcaagggactagtatccagaacacacaagtgactaaaacaactcaacagcaaaaaagcaaataatctggtttttatatgggcaaaagatctgaataaacattctcaaaggaagacatacaaatgtcactatcattctgccagtaccacactgtcttgattacttgttagtgtataaatttttaaattgggaagtgtgagtcatcctacactttgttcttgtttttcaagtttgttttggctattctgggagccttgcaagtataaaatagccaacaagtatgaaaaaatgctcaccatcactaatcatcagagaaataaaaatcaagaccactatgagatatcctctcactccagttagaatggctactatcaaaaagacaaaatataatggatgctggcaaagatttggagaaaggggaactcctatacactgtgggtagggatgcaaattggtaatggccattatggaaaataatactgaggtttttcaaaaaactgaaaatagaactaccatatgatccagcaaccctactactgggtatttatccaaaggaaagaagtcagtatactgaagaaatatatgcactctcatgttaattgcaacactgttcacaacagccaagacagggaataaatctaaatgtgcatcaacagatgaatggataaagaaaatgtggcatatacactcaatagaatactattcagccattaaagaagaatgaaatcctgtcatcccagcaacatggatgaacctggaggacattatatttaatgaaataagtaaagcacaaaaagataaacagtacatgttctcactcagacatgggtgctaaaaagaaaatggggtcacagaattagaaggggaggcttgggaaaagttaatggataaaaatttacagctatgtaagaagaataagttttagtgttctatagaactgtagggcgagtatagttaccaataacttattgtacatgttcaaaaagctagaagagattttggatgttcccagcacaaaggaatgataaatgtttgtgatgatggatatcctaattaccctgattcaatcattacacattgcatacatgtatcaaattatcactctgtacctcataaatatgtataattattacgtcaacaaaaaaaggaaaaaaaagaaaattaagacaacccacataatggaagaaataaaatatctgcaaattatatatatctgataaatatttaatatttataatatataaagaactcctacaactcaagaacaacaacaaaacaacccaattcaaaaatgggtaaaagccttgaatatacacttatctaaagactatatacaattggccaataaagacacgaaaagatgctcaacatcactagtcatcagggaaatataaatcaaaaccacaatgtagaatgtagacaccacttcatatgcactaggatggctagaataaaaaggtaataacaaatgttggtaaggatgtgaaaaaatcagaaacctcattcgctgctgttgggaatgtaaagtgatgcagccactttggaaaacagtctggcagctcctcaaattattaaatacagagttaccgtatgacccaggaatattcctcctgggtctataaccaaaaaaatgaaaacatatatccacataaaaacttgtacatgggcatttatagcaacattattcataacagcaaaggtggtaagaacccatatgcccatcatctgatgaacaggtaaataacatgcggtattatccatacactagaatattatctgcccatacaaggagtgacatccagctacatgctacaaggatgaatctcggaaaccttatgctaagtgaaagaagccagtcacaaatgaccacagattatgattccatgcatcggaaatgaccagaatagggaaatctatagagacagaaagtagattagtggttgggtggggctgggaggacaggtagtacactactttcccagaactactggaacaaagtaccacaaactggggagcttaaacatagaaattgatttcctcacagttctggagactaggactctgagatcaaggtgtcagcagagctggttctttctgagggccctgaggcaaggctctgtcccaggcctctctccttggctggcaggtggccatcttctccctgcgtcttcacatcatcttttctctgtgtgtgcccatgtccaaattttgattggctcattctgggtcatggccaattgctatgcacaaagtgaagtctacttccaaaagaagggaagagggaacactgactaggctaaacttatagtcattttaatgtccgcttttcctatgagattgtgaacacacagaagtagggtttttatctacattgtgcaaagtttaataagaaaaatagaattcaagagaagcagttcaatagcaggaatttaatatgggaactaattacaaggtttagggcaggactaaaaagccagttgggatggtgagccaacccagagattagcaacagtgggaccccatctacctaccacccatgaagctggaaggataaaggaggggctattatcagagtccacaagccagtgtcagagtccttggctggagctgggaccaccctagagacactgtgcaaagcagaaaacaagggggaaaaaccctgacttctcccttcctcccacctttcaatctcccactagtgcttcctactagccatacttggccagagacagtgacaaggaacactgcaaaatgaagtttgtaggaatcatctccctctgagacagagaaatatggaagggtagaaaatgaatcagaggataaagagaaaaaaccctgagtactatcttatttatctttgtatctccagtgcctaatctgtctctcaaaaaaggaaagcaattgagagaaactgaaaactccaattgaaatgaaagaatggagaattactggactagaagagaagagaaaaatttattccgcatagagtaaacaagaatggattcacaaaggacgtgatgaatgaaaagctataatcagcaaagatttgccagagaaattaaaaagtggtaaactcagccacgctgtacaacctgaaggcacaatgcatgaaaacgtttcaagaaatgacaagatttgaagtcaaattctaagtgcttttccagaatctctcaagacgattatatagctaccccattttattaaataaaatggaaacttactaaactttccccttgtattaaactaacatatgtcctaatagcaaacgattctggaattcctagagtaaaatatatttcgtcaaagtgtattgctcttttaatattctgctgacctccttttgctatttaggatatttgtatacacatcacacgtaaatttggtctatagtttacatctacgggcttatactgttctttttttcatttttttaaaatttccaacccccagtatccatatactgctctctatcagggttattttaactttgtaaaatcagctgagatgctttccatgttttttttttttattttctgccacatttgaatagcataggagttaccaccatcaaccttggattatttaagcattcacgattccacgtgtggattttttattcagagtctttcttgtcattcctgctatcagcacagaacccaatctcagctttccagctatactctcaccccatggaatttgcagatgaagttcaaaaggacctttgcattatcctgcctcgccctcttcccccttcatttagacatcaccttcttctagaacgtcttacctgacatgccctgctcccaacccctgctgcccaattgtgtgctctcccgtgtcctggcctgccatcctctttagtaattgcctgctccctcatctgtctccccacccagacattaagctgaatagactggatttgtgtcttgtccatcactataatctcagcacctagtacctagtaggtacttaccatgtattcattagcaaaatgttatgtataaccttgcaccttaaaaacaagagaaggaagacaaaattaagtcttaagactatggtttagaacatggatcagaaactacagtctgcagcccaaatccagaccaaatgaagagaccatgttcatttacatacaacctatagcagctttcacactacaggagcagagctaagtagttccaagggaacacacggccctgcaaagcctaaaatatttactctatagctcttcacagaaaaagttttcagatccctcgtttagaactcttgttcatatgcaatttcactaaaccatagttttttgggtttgtttggttttttttggcaaaaaggaatgagccgatccagaaaaggttgaaaagaatgaatcattactgctgaaagaatgtgcacacagtccgtcagtattctgctgccatgctgacacccatccaatagtgtcatgagatgcagcagctactactgtgttctcaatgccgagtccacccactccataaccatgtccaagcaatcttgggaacatcatcaccatgcttgtttatccttaaggtattgcctcacatacagcagtggctggtcataaagtcaaatgacactagtggccaggaggtcaagagaatgagtgaggacaggtgggtaggcagcccaggccctagcaacagcaggagctcacccctcagtcactctagccaggactgaaatacttttcaccctttcaagagagactaggaatctggatttttatgtgaaatatcttgattactaaatgttgtcaacagacatgtcaaaaggtaaaactaagtaagttcatggggcagattgactattcaggttatagaattaaggattcttatccaacacagataccaaccaaaaagctgacgtataacatattaggagaaactatgtgcactgtcgaaacatcaacaaggggctaatgtctaaaatagtctatattggattccagttgaaacatggggaaaggacatgaacaggcaacttatgtcaatggaaactcaaaaagataacaagcatatataaaagcattctcaaattcagtagtaaacagacagatgcaaataaaaagagggaaactgctgccgggcacagtggctcacacctgtaatcccagcactttgggaggccgaggcgggcggatcatgaagtcaggagatcgagaccatcctggctaacatggtgaaaccccgtctctactgaaaacacaaaaaattagccaggcgtagtggtgggcaccagtagtcccagctactcaggaggttgaggcaggagaatggcatgaacccaggaggcggagattgcagtgagccgagaccatgccactgcactccagcctgggcgactgagtgaaactccatctcaaaaaatataataataattataattataataataataaatagtaaataaataaaaagagagagactgctaaagtctagaaagttgaatgatgccaagcgcatgcaaagatcagggccttgggatggccgggtgcagtggctcacgcctgtaatcccaccactttgggaggccaaggcgggcggatcatgaggtcaagagatcaagaccatcctggccgacacagtgaaacccggtctctactaaaagtacaaaaaaatatatatatatatatatattattatattatatatatatatatcagagccttgggaatccttgtgtgctgctggggaaggtagtggtgcagccacccttgacagcaatctggcagtacttggttatattaagtataggcacacaccacgaccaggcagtcctactcctgggtctaaatcccaaagaattctcacacaagtccataaggagacatgtacgaggctcattcagcattactgggagtgggaatcaacctgggtgtccatctacaggagacgagatggacaaaatgtggtggatattaagaccagaatcaccaagtaacagagatgggtggtgagtgacaatcctaagatacagaataaaggctagaacatgatgccattcatgtaaattaaaaatagatgcacacaaagcagtatacgcgtgacccttgaatagcacaggtttgaactgcctgtgtccacttacatgtggattttcttccacttctgctacccccaagacagcaagaccaacccctcttcttcctcctccccctcagcctactcaacatgaagatgacaaggatgaagacttttatgataatccaattccaaggaactaatgaaaagtatattttctcttccttatgattttctttatctctagcttacattattctaagaatatggtacataatacacatcacacgcaaaataaatgttaattgactgtttatattatgggtaaggcttccactcaacagtaggctgtcagtagttaagttttgggagtcaaaagttatacacagattttcaactgtgcaggcaatcagttcccctgaccccctcattgttcacgggtcaactgtatatacacaaaagtattatatgaacctcattagaatagctgtctatagggagaagagaatgagagtgggataaaacggaatgaacaaataaaccaacaaatgcattaacaagcaaaacaacagaggggcttgcatgggccagtgatgataaagggctaagaatgagaatataattaattcaattcctcacacctgaggtctaaaaccaaggaaagggagggccaggcgtggaggctcacgcctgtaatcccagcactttgggaggctgaggcgggcggatcacaagattaggagtttgagatcagcctggccaacacagtgaaagcccatctctacaaaaaatacaagaattacccaggtgtggtggcacatgcctgtagttagctactctggaggctgaggcaggagaatcacttgaacccaggaggcggaggttgcagggagccgagatcacaccattgcactccagcctgggtgacagagtaagactctgtctcaaaaaaataaaaaaaataaaaaaacagagaaagggaggaaactagatccaggctgactagatacagcctttagagttagaaaagatgatttgacaatctaagcccacactcagattgaatgaaattgaaaagcctttcaaactaaaacatttaattacaccatctgctgcagacagaactcagacaactcaaacaggtaatgtcagcgtggtgttttatatcaccaccctcaacacagaataaaaatcagctgcatgtgaagcagtgactagaatgaagaaaaggctgcttcttacttccttctagtggttctttccgaaaacattaataggcaccagctctatgcatgtcaccctgcagggagacatggggtatataactatgacttactgttcattcctcaaggaattcccaatcttgtggaagattatacacaatgaggcaacaaaaactatccaataaaaccacggaaaagaagccagtgacaaagaagccagtgatgaaaggccctgtgagcagagctgatggccatttggggaagaaagaccaacatggatgggggtgatcagggtggctccgtgggaaagctggaagagaagtggcagatctctgagctggatgatgggccactaccatctgtatatggctaattaaagaccatgtgtggattttttattcagctctttcgtgtcattcctgctatcagcacagaacccaatctcaactttccagctatattgagctaaacttctcacctcatggaatttgcagataaagttcaaaaggatccttgccttttcaaaataattttgaatggttgagtagtccctctgtgctctctcactgacaccctctcaaggctgctgagcacgtgccatgctatggctttctccaacatcaggaaatgttctccactcagtttcaccttaatacaaatgtgttctctcttcagagaaggcaaaaaaattcatgaccatctgactgggagaagtcatttctaggtaaagtgtccatctttttctgaggaacacaggaggaaaatcttacagaaaagagttaacacagcaggcctaagactgctttttaaaataaataaataaataaataaataaataaataaataaataaataaataaataaatgaatgatagggtcttctgtattggccaggctagtctcaaattcctggcttcaagagatcctcccaccttggtctcccacagtgttgggattatagacatgagccattgtgcttggcccaagactgttattcttaaaaagtctcataaaaagcatggttaatccttggctggcacctgggaacttagatttcagaagggttcccaccatccaacctggaaagagggactcactgtgcctaaattattgtgtggtttatgctgaactcctgcttttcttcaggtagcgtggaatgtggtatgtgctgggcaaagggggcctgcatgaccagcccccaataaaaaccctgggtgttgggtctctagtgagtttccctggtagacagcatttcacatgcgttgtcacagctccttcctcggggagttaagcacatacatcctgtgtgactgcactgggagaggatgcttggaagcttgtgcctggcttcctttggacttggccccatgcacctttccctttgctgattgtgctttgtatcctttcactgtaataaattacagccgtgagtacaccacatgctgagtcttccaagtgaaccaccagatctgagcatggtcctgggggcccccaacacagaaataaattataaaagaccaaggactgggcatggtggcccatgccggtaatctcagcgctttgggaggccgaggcaggaggaccagttaagcccaaaagttcaaagttacagtgacctatgactgcgccaatgcactctaacctgggagacagagcaagaccctgtccccaaaacaataaactaaacacatacttctgccttccaagtgtcttaaaattcaatggaatggtagaaacatttttaaaacactaaatcaaaagaaacctggaaaacaagagtgccgatggccaactaaaatgtctaggaaatttctgaaaagtaaaaagtactcagaaccagattacctgagcaaaccatagcccaatacaagcttgggaggaggctgttatgcagaaggaaatggtaacaggtttccaggaacagacttgtaacagcagatagaacagcagaggtagaacctgacaaggtgattacctggggaactgcagtctgaatgaccaggactgttggacccttcccctcacatggaatacacacgccactcagcagcacaccacagctcttcaacaatcacaggaggcacgctacgcctagtaagacaggaaaaaaggaattctcaaacttcgaagatgaacacataaagaatcaccaagtttttattcagtatgatgaaacagggacactgaatcaacagaacacaaacccaagcaaagataattactagagcacatagaagaaattattagatattcttgggaagacctaaggggacattataaagagcaagcagttggtatgtgacgatctttgtgatataccaagaaataaaaacacaggatgaagaccagatagagaataatgctactatttgtgcaaaaaaggagaaatggagaatctgattcatatttgcttgtatttgcatgaagaaactttggaaggtacataagtaactaacaacaatggttacctacttgtaaggcgagagaagtaagaggacaggaatggtgggaacaccttttgtgtccggaattggtgggttcttggtctgacttggagaatgaagccgtggaccctcgcggtgagcgtaacagttcttaaaggcggtgtgtctggagtttgttccttctgatgtttggatgtgttcggagtttcttccttctggtgggttcgtagtctcgctgactcaggagtgaagctgcagaccttcgcggcgagtgttacagctcttaagggggcgcatctagagttgttcgttcctcctggtgagttcgtggtctcgctagcttcaggagtgaagctgcagaccttcgaggtgtgtgttgcagctcatatagacagtgcagacccaaagagtgagcagtaataagaacgcattccaaacatcaaaaggacaaaccttcagcagcgcggaatgcgaccgcagcacgttaccactcttggctcgggcagcctgcttttattctcttatctggccacacccatatcctgctgattggtccattttacagagagccgactgctccattttacagagaaccgattggtccatttttcagagagctgattggtccattttgacagagtgctgattggtgcgtttacaatccctgagctagacacagggtgctgactggtgtatttacaatcccttagctagacataaaggttctcaagtccccaccagactcaggagcccagctggcttcacccagtggatccggcatcagtgccacaggtggagctgcctgccagtcccgcgccctgcgcccgcactcctcagccctctggtggtcgatgggactgggcgccgtggagcagggggtggtgctgtcagggaggctcgggccgcacaggagcccaggaggtgggggtggctcaggcatggcgggccgcaggtcatgagcgctgccccgcagggaggcagctaaggcccagcgagaaatcgggcacagcagctgctggcccaggtgctaagcccctcactgcctggggccgttggggccggctggccggccgctcccagtgcggggcccgccaagcccacgcccaccgggaactcacgctggcccgcaagcaccgcgtacagccccggttcccgcccgcgcctctccctccacacctccctgcaaagctgagggagctggctccagccttggccagcccagaaaggggctcccacagtgcagcggtgggctgaagggctcctcaagcgcggccagagtgggcactaaggctgaggaggcaccgagagcgagcgaggactgccagcacgctgtcacctctcactttcatttatgcctttttaatacagtctggttttgaacactgattatcttacctattttttttttttttttttgagatggagtcgctctctgtcgcccagactggagtgcagtggtgccatcctggctcactgcaagctccgcctcccgggttcacaccattctcctgcctcaacctcctgagtagctgggactacaggcaatcgccaccacgcccagctaattttttattttattttttttttagtagaagcggagtttcaccatgttagccagatggtctcaatctcctgacctcgtgatccatccgcctcggcctcccaaagtgctgggattacagacgtgagccactgcgccctgcctatcttacctatttcaaaagttaaactttaagaagtagaaacccgtggccaggcgtggtggctcacgcctgtaaccccagcactttgggaggccgaggcgggcggatcacgaggtcaggagatcgagatcatcctggttaacacagtgaaaccccgtcgctactaaaaatacaaaaaattagccgggcgtggtggtgggcaccggcagtcctcgctactggggaggctgaggcaggagaatggcgtgaacctgggaggcagagcttgcagtgagccgagatagtgccattgccttccagcctgggcgacagagcgagactccacctcaaaaaaaaaaaaaaaaaatagagacccggaaagttaaaaatatgataatcaatatttaaaaacactcaagagatgggctaaagagttgacggaacaaatctaaatattagattggtgacctgcaaaaccagcccaaggaacatcccagaatgcagcccataaagataaagagagcatttccgctgggcacagtggtatggcaggggaattgcctgagtccaagagttgcaggtcacattgaaccacaccattgcactccaggcctgggcaacacagcaatactctgtctcaaaaaaaaaaaaaattaaattaaaaaagacagaatatttgagagaaaaaaatgcttatttcaagaaacatgaaagataaatcaagatattctaattcccaagtaagaataattccagaagcagaaaatagaatagaggcaaggaaacactcaaaacttctccagtgccatagaaatgtgtattaatctttagaatgaaacggactaccaaatgctgagcaggaagaacaaaagagatccactcttaagccagtgtggtgcccaagcgcagtggctcatgcctgtaatcccagcactttgggaggccgaggcaggtggatcacctgaggtcaggagtttgagatcagtcaggccaacatggtgaaaccctgtctgtactaaaaatacaaacattagctgggtatggtggtgcacatctgtaatcccaactacttgggaggctaaggcaggagaatcacttgaaaccaggaggtggaggttgtagtgagccgagatcatgccacactcccagcctgggtgacagagcaagattccatctcaaaaaaaaaatccactcctagacaaataatagttaaattttagaacaccaaggagaaagaaaaaaaattgtaaagcttcagagaaaataaacattaactacaaagaaacgagagtcagacgcgtgcacttcttcctagataccagcagataaagcaatatctccaaaattcagaaggttttaacgtagaatcctatacccagtcaagaatattcacatggaaaagtgaaataaaaaacattgtttaaacatgcaagggttcagaaagtttaccattcacagaatccctgaaaacaaaaccaaataatcacttaaggactcattaagaaaacaaatgaaataaaagcaccaatgatgagtaaataatcagaaaaatttacagtttacctaaataactgtttatgcataatgtatgaaaacccaaaaatttaatatgggacagaattaaaatcatgataagattcttttttgctttactcatggagagttcacataaacagattatcttttaatagcaagagaaaaaaatgtttagatatgtgtgaaaaactaagggtaccaaaacagtgcaaattcatttatcatcaggaaaatccaaattaaaaccacagtatccaccagaataactaaaaggtaaaagacagaaattaccaagagttggcaagaatgtggagcaaccacatatacttctggggtaaataagttggtgcaaccggtactgaaaactgtttgctagtatctactaaaaccgagcacatgcacagactacaaccaagcagttccactcccagatacacactcaacagaaatgcacacactcactcaacaaaagacgtgtactagagtgttcatgtacttactattcataatagtccaaaaatgcaaacaaccaactgccaatcaaagtcaaatgtatatctatattagggatatatacaatggcatatacacagcaatgagaatgaaatgaaccagctcggcacagtggttcatgcctgtaatctcagcactttgggcgggtaaggcaggcagatcacttgaggtcagaaatttgagactagcctggccaacacggttaaaacctgtccccactaaaaacacaaaaattagccgggcatagtggttgcaggcctgtaattccagctactcgggaggctgggttgggagaatcgtttgaacccgaaagccggaggtcgcagtgagcggagatcgtgccactgcactccagcctggacgatagagcaagactccgtctcaaaaaaggaaatcaaaaatataaaataagatgacaggaataatccgcaaaagatcagtaatcaaaataaatataaatgggctaaagctacctattaaaagacaaagatttcacacccataaggatagctactatcaaaaaaagagagagaataacagatgttagcaaggatgtatggaaactgaaattctcacgcattgctggtgagaatataaaatggttcagcctctgcggaaaacactatgctgggtcatcaaaaaattaaaaatagaagtactacttgatccaacaattctacttctgggtatatacccaaataactgaaagcagggtcttgaagagatatttgtacacccatgatcatggcagcattattcataatagctatgatgtggaaccaacataaatatcctttgataaatatatggataagcaaaatgtggtgtatacattcaatggaatattaattagcaataaaaatgaagaaaattctgacacatgctacaacatggatgaaccttgagggcattacattaaatgaaataagccagttataaaaagacaaatactatatgaggtactatattagatactcatgcaaggtacctaaaataggcaaattcatagagacaaaaagcagaatggtggttgccaggggctgcggtaatggatacagagcttcaattttgtaagatgaaaaaattctggagattggttgcataacaatgtgcacacacttaacactggggaactgtaaacttaaaagtagtaaatggtaaaaataaaaataataaataataaattttatgttattttaccacaatatttattaaaagacaaagattaactaattaaacaaaatccagccataagctaatggtaagagtaacaattaaagaagacacagaaaattgaaaatcagtgactagaaaaagatattccatataaatgctaacaaaaagcaagtacagcaatataaagagaatgaacaaaaaaaaaattaaataagatggctcgtttattcccaaaaggtacaattcaccaagaagatacaagaattgtgaacctttaagcacataaaacagcttcaaaaatacaacatttaaagaaaaatatatattaaacatagaaatagtacaaaaacccctacaagaatcataatgggagtcttcaatacaactctccatatcaacaggtcaaacagagaaaaaaaataagttaaggatgcagaaaacctgaattaccatcaataaacttgagattaatatagaactgtatacccaatatactaagagttcagggaacagtcgtgactgacagtggactgcaaattaatctgttcttaatctttgtttttctttcagcactgtggcagaatagagatcctaaaaaccttccagctacaaaacatctttttaaaaatataaaaaaatacaaaaataactctgaaatcaatagaagacacatggtgaaaccaaaattctagaatacagggagaataaaggcattttcagatattacaaaaacagaaaattgatcattgctgaagtaatttctaaagaatgtacttgagggagaagaaaaatgttccaaagaaaagtatctgtgatacaagaaggaatggaaagtgaagaaatggtaaacaggtagataaagctaataaatgttgacctagaaaataacaaaaacaatagcaataatgtctcgttggaagggttgaagtaaaaatacaattaaggccaaatgtgaggtaagtggaatgaaagaattagaagtccttgccttgttcacaggactgattaaataaatgagccaggttttccattcaaacagttaaaacttgaacaaaataaactcaaattaagtagaaagataaaaaacagaaattaatgtcatagaaaaataaaaaatcaatagaattaatcaataaatcctggttaataaaagctggttctttgaaaggattaataaaataatcattaagcaagtctgatcaaaaaaaaagagaaaaggtaccaaaaaaagtactgtatcagaaagagaacatacagatacatacagatatgtaagagtctgttttcttacaccagaatactatatacaacattatgctagcatatattaaatttcaataatgttaatgattttctaggaaaacagaaaatattaaatttactttgaagaaacagaaaaactgagaaaaataaatgatcatgaaaaaaatgaaaaggtaattaaatactgatattaactgcctaaacaacaccagcagcagcccaggcagtctgcagtcaagttctgccaaacttgagggaacagataattcttctattccagagcatagaaaatgatggaaagtttcccaatttaatcagagaggacagcctgatccttgttatgaacacagataaaaatggggtaaactatatgccaaactcagataccaaaaccctaaataagatgctagcttattgatgtgaacaatccaaaagtgcattttaaattagcccagggttttagagaaagaaaatctagcaatgtgaccaccacttatgttaacaattttaagacgaaaatctacatgatcatatcaatgcatgctacacaaaagcatttgggcaaaaaacccaacacccacccttgactttttaaactcttagtaattaggcataaacagaaatgtacttaatgtgatagaatacactcggtgaagatacagagggaatgctccctaaaaccaagcccaagacaaagattcctatttaacctcaatagtcaacactgcagcgagagtaatctatggaagacaaggaaaaaagtaaaaacatgagagacatctgttgtttaacagacaataagatcacctacttggaagaggcaaacgaatcaagcgaaaaactattaaaactgagacaggctttagtatggaggctcagcttcagctgtagtttgggctaccaaattcaactcgcttgcttggagagttaatcctgcaaagctaatttctgttgaggtattaggattgacaagcctgtgctcctccctcctcccccatcttcaacactgaaataacacggtgtttggaactggataacagaatcttccaaaaacaaaaattgtcctgaagggctgacttgtgcccttactcaaaaaacactttatctgctgcctgcagctcctacagttgctggtggataagcctgccaaccagctcggcgtaattcttcctgcagagggcaaggaagagcactttcacaggaaaatttttttccgaactgtatgccgcttattacataaacttacgtgctggcaaatggagctccagcaaaataagatattcagagtcaaacttccttaggaaaaaaaaaaaaaaaaagcaagcacataacactaatttccttgcatgggcactggggaaggaggtcgttacttccgcacgcccgcaggtccgcaccaccgggaaacccacgggcaccgcgcgctgcccccgggccttccaggtgcactgcgccgcggcgccccagctgacccgggatgcgcagccctagcccttcccctgtcaccccggccaggaaggggcgggagcgcggcggacgccgagggcgaagggcttctcggtcctctgcaccacgcagcacccccaaggcacaacagggagggtgcgggaggctcccgagacccaggagccggggccgggcgtgcccgcgcacctgtcccactgcggcgagggctggggtcgcctccagggccgcagctgtcgggagccacctggctctcagtcccgggtccctgcgacaaccctcgggcccggaggggaggaggcggccacctgccgctgccacctgcggcaccggtcccaccgctccgggccgggcaggacaggccaggacgtccctcctgggctggggacaggacacgcgacgaggggaccggggcccccgcggcgaagacgcagcacgccttcccagaaaggcagtcccgtgcccccacgacggactgccggacccccgcgctcgcccgcccatcccttcagaccacgcggctgaggcgcaaagagccggccggcgggcgggctggcggcgcggctagtactcaccggccccgctggctcagcgccgccgcaacccccagcggccacggctccgggcgctcactgatgctcaggagagggacccgcgctccgccggcgcctccagccatcgccgccagggggcgagcgcgagccgcgcggggctcgctgggagatgtagtacccggaccgccgcctgcgccgtcctccttcagccggcggccgggggccccctctctcccagctctcagtgtctcatctccctatctgctcatcctctggtcgcacataatcgatgtttgggcgtcccaagccagatgtggaccccatttccgcactctacactggaggttttctaagggtggtgcccggaccagcagcttcagcctcatctgggaacttgagaaaatgcagattctccgtcccacccagcctattcggtttttcctgcactaaaaccatgaaggtggggcccagcagtccacattctcgcaagcccgtcaagtgattctgaggcgccctccagtttgagagctatgctcacggcctcacctccgccccgcaaggagcccggtcttgcctgtggcgctagccgcacacggacacctcatcctgcggggcccgcccccccgctgcaccctcaccgcccaacgcctcctccgggatgcagcggaggcgcctggaagtcggcaaggtcaacatccccctcagcatcttccctaccctcacggctcctcctccaggggtgcctcatggccaggggttagaaagagccactgtgtttcttgacatggaagtggcctaagaccttaatgaaaactgcaggagtggaatgacagaacctttggtcatacttgagggcgtgaagctcaaatgaggaggaaggaaaggatccagggagaataaccaaccctggcaagttgtggcgcccaggtagaggggcgagcctaggctagcggttctcgaccagggccggtgttgcccctcctcgccgccccgcgtacatttggggaggtctggagacatttttggttgtcatgatgcgggagttgctactgttgcctaagtgggtagacacgagggtgctcctcaacatcctacctgaaggacaggactgccccacaaggaagaatgatccggccccaaataagaaaccctgggctggtcagcaacaacccctttgttctgagaagagaggaggaaagaataaaagaagtggggtgaagttttggtttggtagaggaaacttgaagacattttcactggaaaggaagagaggaagaggagggagatgtctgtaaggacgagcaaaccgggtgacagctgatttcctcatattgaagtaatgagtcctagttataataaattcctaataaaaacccagtttatccctgcaataaacttgtcttttttttttaaatatactgcttgattctgtttgctaatattttatttacaggctttgcattgatatgcaaaaatgagatgggcaataattttctttttgaatgtctaatgttgtttggtttcagaatcaatgttatgctcacatcataaaaaatttggaaccgaggcaggaggagtgcttgaggccagaagttcgagaccagtctaggaaacacagtgagacccccccatctctacaaaaaaaaaaaaagaaaaaaaaatgggcatgtttgctttttccttttactctgaacaatttaaggagcattaaaattatctattctttgaggtttgatcatttcccagttaaaaatgttcctcccagcctgatgctttctttggggagggtaaatcttttaaggctagaaaagtttcttctgtggcaattttattatttacattttaaaaattattctagagttaattttgataaagcatgtatttcttaaaacaaattatcctttttttccagatgttcaagtgtatttgcataaagttgaggaaagtagtcttttgtgaatcttttaacttctcccaaatatcttattttgtgtatttttgcttctttattttgttaacttttaaaagtgtatttttttttcaaagaatcagctcttaggtttatgtttttggttatactggagcttttttcttcttctttttaaaatattttttctcctttattttttagacgtattttgatctaacgtaatcggaagaaggtaaattagaatcttttgttactattgtgtttttatttctccttatttctctgaagtcctgctttataaatagtaccatgttatttgtgcataaatattcatttgtcttatattcttgggaattttcccacttcatcataaaatgaccttccttgtctcatttaatgtgttcaaactttgccctgaatttaactttgtctgatattttaccatcctgctgaattttgtttgttaccccaaacaacctttgctgttttcgtcttttctgaaccctttattttaggtaatcccttgaattagagcactaagttttgctttgtgattaaatctgaaaatctttatcttgccatagatgagttgagccctattcatgtgacagctatattatgctgtttcatagcccttttggtccttttttcactcttgcattgcatattttgtgtttattgtgttttgtgtttcttctgataatttggaaggtttgtatttttattcagggagttgccttataatcatactccgcaatacacatcgtcctcagtttcttcagactgtctgttaactccctattctgaataaaaatgacattgtaatttccctcttttttctttaccccttttcttctcctcacctaatgtaaatgattttatccttctttagtatttgcttttttaattaactacatttataaatatctttatcacttgatttttaaatcagctttgaatgagatatttggattcctagatataaaagatgttaattataccatttccacgttagtaggtttataaaatcatacattctgctgtgtaaccataatcccacgtttgttttagttccactcctacagttaaaagattcagaagtattattaacagttattttgccatagttttttccccaacccattttgtggtaagttatgatcctgctttagtttcttaagaataatttatagagcagagtgtggtggctcacgtttgtaatcccagcactttgggagacaagaggtagaaggatcgcttgaagccagcagttcaagaccaccctgagcaacatagtgagaccttgtctctacaaaaaattttaaaatttagccagacgtagtggcgtgtgcctatagtcccagctactcaggaggctgaggcaagaggattgctagagcccagaagtttgaggctgcagtgacctctgattgtgccactgcaccccagtctgggcaagaaagtgagaacctatctctttaaaataacaataataacttatgaaaattatattccctgagtttttcatgtttaaaaatatttgttgcctttatcctgtaaaagtttgagtataaattcttgggttatactttatttattgaagaatgtataagtattgtcttctagaattgagtgttgctgtaatgaaaccagaagtcagcctggtttatttttcctcagaaatgaggtaattgccggccggacaccgtggctcatgcctgtaatcccaacactttgggaggccgagacaggtggatcacgaggtcaggagattgagaccatcctggctaacatggtgaaaccccggctctactaaaagtacaaaaagttagctgggcatggtggtggacgcctgtaatcccagctacccgggaggctgaggcaggagaatggcgtgaacctgggaggaggagcttgcagagagctgagatcgcgccactgcactccagcctgggcgacagagtgagactccgtctcaaaaaaacaaaaaaaaaacaaagaagtgaagtaattgccatgatgctccaagaattatctctttgtctatgaaatccagaaatctcactgttatacattttggaattattattctgggccaatatttcctgggacacaatagattgactctatagatttaattttttttttttttttgagacagagtctcactgcaatctcagcttactgcaacctctgcctcacgggttcaagcaattctcctgcctcagcctcccaagtagctgggactacaggcgcgtggcaccatgcctggctaatttttgtctttttagtagagacagggtttcaccatgttggccaggctggtcttgaacgcctaacctcaagtgatccacctgcctcagcctcccaaagtgctgggattacaggcgtgagccaccatgcccagcctcaattcctctttctatctggtaatttttctgaagttgaaaacatttgttctaatacgttatttcagtgttcttctaagatgtgtaaagcaccctattcccaggtcagcccccatcttgctagtgagctcggctggttcttcacaagagctctggttttctcctgcttaatctcaagtacctctgtcagcctccacctggtttatgatttggagttttttggtttttgttttttgtttttgacagagtcttactctgtcacccaggctggagagcagtggcataatctcagctcactgcaacctctgtctcccaggtttgagcgattctcctgcctcagcctactgagtagctgggattacaggcgcgtgccaccacacccggctaatttttgtatttttagtagagatggggtttcaccatgttggccagggtggtcttgaactcctgacctcaggtaatccacctgcctcagcctcccaaagtgctgagattacaggcgtgagccaccgcgcctggcatggtttggagttttaatctgtagttttaataaagatagtgcttatgtttgtgtttcttatatttcttggtactcttgggtaatttgtaagatccccatatctacacaagaagtccattttcaattcttttcttcagactgtttattttattttattttattttatttttatgtttgagatggagtctcgctgtgtcacttctggaggctggagtgcagtggcgcgatctcaggtcactgcaacctccgtctcccgggttcaagcaattctcctgcctcagcctcccgagtagctgggattacaggcacctgccactttttaatttttttagagacagagtctcgctttgttgaccaggctggagtgcggtggtgcaatcatggctgactataacctccaaatcctgggctcaagtgatcctcctgcctcagcctcctgagtagctgggactacaggcacatgccaccatgcccagttaattttaatttttttgtagagacagggtctccatatgttgcccaggctggcctcctactcctggcctcaagtaatcctcctacctcagcctcccaaattactaggattataagcatgagccaccatgcccagccttgttctactactttaatttcatatgttaggtgaccatgtaattgatcatccaaaccaggatactgtaagaatgaaagaggctgacagtagtatgatgctgggactagcattgtgcactgagattatttctgggaaagcaggagatacggtcaccctacttatagtgtgcttgtctttggattgttgaatttggagtttctatttgcaggcttatttcaactgggcagccttgatccgccctgcccagcaatgctaccgttctctccaccgggtctctgggaccccttcagtcactatacttagctcagttccccaccctcccactccctaaaagcgtaaccaggaatcctgcctcaggtctactgccgtcttccgtgggctgtttcagttcctattacccagagtcaaactcccagcattccctacctgattccagacttggagtccagagctttaacctcttcaggccaactccccactttgcatttctgtccctatatcttagtccatggagatacatttcatgtctttgagtctacttacaaagtaaattttgctgttttttaattttttttttgagatggagtcttgccctgtcacccaggctgtggtgcaatgacgccatctcggctcactgcaacctccgcctcctgggttcaagcgattcatctgcctcagcctcccaagtagctgtgattacagacaggcaccaccacgcccagctaattttttttatcttttagtagagacagggtttcaccatgttggccaggctggtcttgaattcctgacctcgtgatctgcccatctcggcctcccaaagtgctgagattacaggcgtgagccactgtgcccagccaattttgctttttttatatttcattgctatatgtttagaggataagtttacagtgctatatgcattcccaaatattagaccaaaaaaatctccaaaaaattagaaagaaaatccaaaaaatctcaaaaaataccaaaaagcaacaatctcacagaccatactcactgacccccaataaaataaaattagaaattaaccacaacttaacaaaataaagtactcaagtcagagaggaaagaggaaataaacatcaaaattacaaagtctaggcggtggctcacgcctgtaatcccagcactttgggaggccaaggcgggcagatcacaaggtcaggaattcgagaccagcctggccaatatggtgaaaccccgtttccactaaaaatacaaaaattagccaggcatagtgatgtgtgcctgtaatccagccacttgggaggctgaggcaggagaatcactgaacccagggagacgaagattgcagtgagccaaaatcgtgccactgcacttcggcctgggtgacaaagcgagactccatctcaaaaaaaaaaaaattacaaactctttagatagaaattttggtgtttttttttgagacggagtctcactctgtcgcagaggctggagtgcagtgggactatgtcagctcaccgcaacctccatctcctggattcaagcaattctcctgtctcagcctcccaagtagctaggattacaggcgcccaccaccagacccagctagtttttatatttttagtagagatggtgtttcaccatgttggccaggctggtctcaaactcctgacctcaagtgatccacctgcttcagcctcccaaagtgctcagattacaggcgtgagccaccgcaccccacctagatagaaatttcaacatgaggccgggcacaatggctcacgcctgtaatctcagcacttcaggaggctgaggcgtgggaggatcacttgggcccaggagttcaggaccagcatgggtgacagagacagaccctgtctctatttatttgaaaaaaaaaaaaaaaaagagagagagaaagaaatttcaacatgaaaagtatctctcaaacccttcgagatgttggcaaaaagcgactcaaaggaaaatgtattactgtgtgtgaatttgcttgaaaataagaaagaggccgggtgtggtggctaacacctgtaatcccaacactctgggagtccgaatcaagtggatcatgaggtcaggagatcgagaccatcctggctaacatggtgaaaccctgtctctactaaaaatacaaaaaattagctaggcgcggtggctcatgcctgtaatcccagcactttgggaggctgaggcaggtggatcacctgaggtcaggggtttgagaccagcctggcctacatggtgaaacctcgtctcttctacaaatacaaaaattagctgggcgtggtggtgggtgcctgtaatcccagctactcagaggctgaggcaggagaatcgcttgaacccgggaggcggaggttgcggtgagccgagatcgcaccactacactccagcctgggcaacagcctgggtgacacagtgagactccatctcaaaaaatacaaaaaattagctgggtgtggtggcctgcgcctgtagtcccagctacccgggaggctgaggcaggagaatggagtgaacctgggaggaggagcttgcagtgagccgagatcccaccactgcactccagcctgggcgacagagcaagactcttgtctcaaaaaaaagaaaaaaaaaggaaaaaagaaccctgataataaagaaaccaaatgttcaactctcaaagctcggacactttaaagaaataattaataaaggcagaagttaaagggaggatgataaagcaattttttttgttggtttttttgagatggagtcttgctctgtcacccaggctggagtgcagtgatgcgatcttggctcactgcaacctctgcctcccgggttcaagcaattctcctgcctcagcctcctgagtagctggtactacaggtgcgcgccacctggcccagctaatttttgtatttttattagagacggggtttcaccatatttgttaggctggtctcaaactcctgatctcaggtaatctgcccacctcggcctctcaaagtgctgggattacaggcaggcgccaccgcgcctggcctaaagcaaaatattggttctgtgcaaaaggtcaataaaaagagcaaacgtttacaaactggagccagcacccattcagctcagtgtgtctggagaaaaaacaatctcgcttcagaattcatgattacgcagccctttttgcttcctaaaaatcctactatgttgctgttgaccattctctctctttctctctctcttgctttctctccagaaaagctattcagacattctcctctttcctcaaacctccaacacttcctcctccatccttagcctcagctgctgacctcacttctaatcattgagaaaccaggagaagcatttaagagtgaacctccgcctccccgcacgggcaaaaccacccacccacagaattgtgccccaattctgcgtcctctcctctcaccatggatggacggtccaggctccgagccaaagccaggcctcccctggagctctggatccaccacctgcagcttctcaggcagggccccagcagctcccctgctcccttgtaccatcaatccctcccctcactgggtcactcccaacaatatatatatttagtgatgtttctcccatgtggtaaaatcacttagcctctctcctcccccagctactatcctatttgtttctttccattctctgcaaaacttctcaaagcattgtgtctatgtgctgactccatttatcttctcccgttctctgctgagtccttcccacagactctcaccccagttactccatgaaatgacctctgcactgccacatccaatggtgaatgttcagttcttaattttattcagtctttcagcagcatttgacctggccgatcactccctcttcttaaaaatacttttctcagccaggcgtgatggctcacacctgtaatcccaacactttgggaggccaaggcgggaggatcatgagagcccaggagttcaagatcagcctgggcaacatggcaagaccctatctctacaaaaactaaaaagtagccagtgtgatggcatgcacctgtagtcccatctacttaggaggctgaggcagtaggatgacttgagcctgggaaatcaaggctgcagtgagccatgattgcaccactgcactccagcctgagtgacagcgagaccctgtctcaaaaagacaaaataggaaacttttctcagcatattcctctgattctcctgctgcttctgtctgcacagattcagtctcctttgccggttcttcctcatcctcctgatctcttgaccttgaagtgccccagagtacagtctttttttttttttttgagacgcagtctcgtctgtcacccaagctggagtgcaatggcgaggtctcagctcatgcaacctctgcctcctgggttcaagcgattctcctgcctcagcctcccaagtagccaggactacaggcacatgccaccatgcccagcaaattgttgtatttttagtagagacagggttttactatattggccacgctggtctcaaactcctgaactcgtgaaccacccgcctcggcctcccaaagtgctgagattacaggcatgagccaccacacccggcccagagtacagtctttagacggcctctctacctatacttgctcccctcataaactcctcctgcctcatggctttaaataccatcggtagactgatgactcccatatttctcttttttttttggagacggagtctcgctcagtcccccaggctggagtgcagtggcgcgatctcggctcactgcaagctccacctgccaagttcacaccattctcctacctcagcctctccagtagctgggactacaggcacccgccaccacgcctggctaatttttttgtatttttagtagagatggggtttcaccatgttagccaggatggtctcgatctcctgacctcgtgatccgcccatctcggcctcccaaagtgctgggattataggtgtgagccaccgtgcccagccgatgactcccatatttctatctcttgctgtgtgggagttctcctcagaactccatactcataaatccaactctcataaatagtatctcaaatgggcaatatgctcaaaagtcaattcctacttttctccctaaacttgctttcctgcagtctccaccatcttaatgtccaatctaacattaggaggcaaaaactttgaagtcattcttgactcttctctattacacaccctatccaatctttctgcagatccagtcgacccccaaatccagttagctctcatcatctcccctgttaccccctggtccaggccatcttcctctctcacctgaatcactgcagcattctcctcactggtctctttggttctgttttcactccaccttagcatagtctccacagagcagtcagagggatccttttaaagtgtaattcccatcctgtccctgctctgctcaaaaccctgtcgtgattcccgttttaatctgtcagattaaaagccagagtctttccagtgacctacatgatctgcctattatcacctcccacttctttccccttgctcactccactccagctctgcagctgtcctttctgtttcctgaacagcccagattttgcttctttagaacctttgtatttgctgtcccctctgtctggaatgtttttccaggaagtcacctggctctctcctgcacttccttcctgaccaccatgtttaaaaatcactcaaacacacttcaggccggacatggtggctcacgcctgtaatcccagcactttgggaggccaaggtgggtggatcacctgaggtcaggagttcgagaccagcctggccaacatggtgaaacttcgtctctactacaaatacaaatagtagccaggtgtagtggcacacacctgtaatctcagctactcaggaggctgaggcaggagaatcgcttgaacccagaaggcagaggaggtgcagtgagccaagatcacgccacaacaccccagcctgggtgacagagcaagaccccatctcaaaaaaaaaaaaagaaaaaaaaatcacacaaacacacttctcttcatattccttttccaagttttatttttctccagaatactttacattgttttaatggaagttctccgtttccccccaactagaatggatacttcctgcaggtaggcactctagtcctcccatccaagtactaaccaggctcaaccctgcttagcttctgagagcaggggagatcaggcctgttcagggtggtatggcccaggaattttgattctgttttattcattgctgttctgttgattctcttttgttcctcctcctagtgctgagaacactacttgtacataataagcattcaataaatatttgttgaatgaatgacttgttgaatgaattaatctcagaaatgcaggactggttctacattagaaaatttttcaaggtcattctctgttgtcgtaacacattaagagaggaaaattttgtactctaaatcatttgataaaatacatactgatttctgttttcaaaaactcttagtggctgggcgaggtggctcacatctataatcccagcattttgggaggacgaggtgggcggatcacttgaggtcaggagtttgagaccagcctggccatcatggtgaaaccctatctctactgaaaatagaaaaattagccgggtgtggtggcgcatgcctgtagtcccagctacctgggaggctgaggcaggagaatggcttgaacccgggaggcggaggttgcagtgagccaagatcatgccattgcactccagcctgggtaacagagtgagactccatctcaaaagaaaactcttagtgagtttaggaatccaaggaagaccctcaaactaaatagataatctagctaccagaagccttcagtaaaccttaacactccatggtgaaacattagaaacattcctactaaaagacaggctaagaatgcctgcaatcttcacggctagtccaagaagtcaaaaagaagaaatgagcgctgatttaaaaaaataaacaaacaaaaaactaccgatgcagaggctggcagcaaggactgaaggactgtacagtacttgcctggagcaggcggatggccacacccctgcgaagcctgctcagctggctgggggacgctccagtgtgtgagtggcaggatgcagggtacttcctctgccagggagttgcactggggagatcctcccccactcacactttggcagctggggctttggaatgtgacttagcttctgtcaaagggtcaatccaccctttgatatatgatgcaaaggcgaacatatgatgcaaaggtgagagaacagcccaaattaggacttttaccacagctgtggaggtggacagcgacagtggtgggccctggccagacttttcatgctcaaaggtggtggttgttcttcctacttcttgtccctccagggcttcctttgcctgtgtgctgaacctgcttcttttaattttttttaacttttttaaatttttaattgttttaattaaaacaaattttgaaaactgtctgaacctgcttttgaaccctgctatgatttgaatgtttgtcccctgccaaactgattttgaaacttaatctccaaagtggcaatattgagatggggctttaagcagtgactggatcatgagagctctgacctcatgagtggattaatggattaatgagttgtcatgggagtggcatcagtggctttataagaggaagaattaagacctgagctagcatggtcgccccttcaccatttgatatcttacactgcctaggggctctgcagagagtccccaccaacaagaaggctctcaccagatacagctcctcaaccttgtacttctcagcctctgtaactgtaagaaataaatgccttttctttatgaattacccagtttcagatattctgttataaacaatagaaaacgaactaaggcaaactctcatgattctactgccatgccattccaataaactccctttatgcttaagagagccagagttggccaggcgtggtgactcacgcctgtaattccagcactttgggaggccgaggcaggtggatcacaaggtcaggagatcgagaccatcctggctaacacggtgaaaccccgtctctactaaaaatacaaaaaaattagctgggcgtggtagtgggtgcctgtagtcccagctactcgggaggctgaagcaggaggagaatggcgtggacccaggaggcggagcttgcagtgagtcgagatcgtgccactgcactccagcctgggtgacagaatgagactccgtctcaaaaaaaaagagagccagagtttatttctgttgcttgcaaccaagaaatctggctggtgcactgaagtttccataaataatagcaatttaaagactctttccaagccaggcaatgcctagccttgtgtagtccttgtggtaatacattcattcattcatttgttcaaccaactgtgctccagagactaagaatacaaaaatgggggccgggtgtggtggctcacacctataatcctagcactttgggaggccgaggcaggtagatcacctgaggtcaggagttcgagaccaacctggccaaaatggtgaaacccctactctactaaaaatacaaaaaattagctgggggtggtggcggacacctgtaatcccagctactcgtgagactgaggcaggagaatcacttgaacccgggaggcagaggttgcagtgagccgagatcgcaccactgcactccagcctgggcaacaagagcgaaactccacctcgaaaaaaaaaaaaaaaaaaaaagagggccggggctgggcgcagtggctcacgcctgtaatcccagcactctgggaggccaaggcaggagaattacgaggtcagcagatcgagaccagcctgaccaacatggtgaaaccccatctctactaaaaatacaaaaattatccgggcgtggtggcgcacacctctagtcccagctacttgggaggctgaggcaggagaatcgcttgaacccgggaggcagaggttgcagtgagccgaaatcatgccactgcactccagcctgggtgacagagtgagactccgtctcaaaaaaaaaataaaaaaaaaaaaagaattcaaaaattgtagagttatagtgtgcttctagtttagttgagaggacatctgtccttcaaggaaggctagaatctataccctgagtccttactgaaatcaatccagcagtcaaaacatgggaccaacgatcacagcagtaagataggaagagcacctttgtacatttagctcatgttgagataagccactgacagagctgaaggaagctcacagttctgggttccatcctttggcatttaaaaagaaaagtgctaagaaaattcggttggtcacggtggctcacgcctgtaatcccaacactttgagaggccaaggcaggcagatcacgaggtcaggagttcgaaaccagcctggccaacatggtgaaaccccgtctctactaaaaacagaaaaattagccgggcatggtggcgcatgcctataatcccagctactcaggaggctgaggcaggagaattgcttgaacccgggagggggaggttgcagcgagtgagagcaggccactgcactccagcctgggagacagagcaagactctgtctcaaaaaaaaaaaagaaaaaaagaaagaaaggaaaaaaagaaagaaaaaaaaagaaaaaagaaaattcaggccaggccaggcctggtggctcacacctgtaatcccaacactttgggaggctgaagcgagacggtgccttagcccaggagtttgagaccagcctgagcaacatagcgagaccctgtctctataaaaaaaaatttttttttggccagacgcagtggctcacgcctgtaatcccagcactttgggaggccgaggcaggtggatcacgaggtcaggagatggagaccatcctggctaacacggtgaaaccccatctctactaaaaaatacaaaaaattaaccgggcgtggtggcgggcgcctgtagtcccagctactcgggaggctgaggcaggagaatggcgtgaacccgggaggcggagcttgcagtgagccgagattgcgccactgcactccagactgggagagagtgagactccgtctcaaaaaaaaaaaaaaaaaaaaaaaattaattgtcaggtgtgctggcatgcagctgtagtcctagctactcgggaggctgaggtaagaagatcgcttgagcccaggagttcaaggctgcagtaatagtgcctctcactctaccctgggtgacaatgagaccctctctcaaaaagaaagaaaaaagggaaagaagaaaagaaagaaagaaagagaagaaaggaaggaagaaagaaagaaaaagaaaaggaaggaaggaagaagaaaaaaaaagaaagaaagaaaagagagagaagttcaaagaccaaagggtcaggatcccaaaatagtttttatgttttatttatttatttacttatttatttttgagacagtatggctctgtcgcccaggctggagtgcagtgatgcgattgcggctcactgcagcctccaaactgggctcaggtggccctcccacctcagcctcccgagtagctgggaccacaggcgcgtgccaccatgcccagctaattttttaattctttgtagagatgaggtctctatatgctgcccaggctggtctcgagctcctgggcttaagccatccacccgcctgggcctcccaaagtgctgggattacagaagtgagccaccgcgcctaatcgggtggtttgtttgtttattgacggggtctcgctgctgcccaggctggagtgccagtggctgttcacaggtgcagtcctggagcattgcatcagctcttgggctctagcgatcctccagagtagctgcagctgggattccaggcgcgccaccgcgcggggctcagaatgggtttttatattgagggttatgctgccacctagaggatatatgtagtaccgaactgtgtgcgcagggaggctgaggttgcagtgagccaagatgatgccagggcactccagcgtgggtgacagagcaagatttcatctcaaaaaaaaaaaaaaaaaaaaaaaaaaaagaattgaaagtaaggtcttgaagagatatttgtgcctgtatggtcatagcagtattaactttgacccactagctaaaacacaaaagcaacatgtgtctgtcagcaggtgaacggataaacaaaatgtggtatatatgtacaattgaatattattcagcctttaaaaaggaataaaaggctggatgcgggggctcacgcctgtaatcctaacactttgggagactgaggtgggtggatcacccgaggttaggagtttgagaacagcctggccaacatggtgaaacttcatctctactaaaaatactaaaattagccgggcatggtggcacttgtctgtaatccaagctactggggaggctaaggcaggagaattgcttgaactcaggagccggaggttgcagtgagctaagatggcaccactgcactccagcctgggcaacagagtgagactccatctcaaaacaaacaaacaaaaaattattatttccaaagaaacaagaccctgggtccatttcccagcccacacctgatgttgactcacaacacacagcctggtttgctatgagcctgcttcatttaattgtcaccttaacttcacatcaccctcaagtcctggaataactctttgctgacctttgtgtgctgagccatctccatgtcgctcaacgtgcagtccctctcactgcactgagtcaatagccagacgtggtctgactgcagggtcatccttggtggcttaggctgactcgggcatagcagggtgctctgagacctcaccgcatataggctttgcccccaataaactctatataatattcatattatgtggtctgggtgtgtgtagctttgcactgtcttctcgtgacagtgccctcaacctctttcccaggatttcctcctctacctcctcaagtcccactgctctgcaaagaccaaaagctgcagagtcccagctccctcctttacaccccacgacgcagcctcctctctcagaaccctttaaacagagtcttttactgcagatcccaagaacagccacacccctctctcccacccactccagacacacccaggtaattatagcacccagggtaactatgtagatggagtccctggaacatgtggatagtgccccctgggagtatgcaaaagcaacattgctggcacctgcagagaacagggtgacatccaggaatcagagcatgggcctctgggaggtagggatgtggccaggcaggctgccaaaaattggtagagcaaggccacaggatctttctgaccttccttccaaacagaggctcctgtactggtgatccctgtgttgattgaccactcccttcctgggggtcgtggtctctgtcccagttgcccggacttctgtgagtgtcctactgaggtccttttcatgagaagcatgctgtccttccacctgctgggagcaagagtgacaacttcaatactataatagcagtggcatacagagaagaagaaagatgaagtggcaagaaaaacaggcttccaagcaggagtttttctataaaaacaaaaacgtttacaagcaaactttttataaagggctagatagtaaatattttaggctttgagagccacatagacttgtttgcagggactcaatgtcgctattgtagtttgaaagcagccatcagggttatgtaaatgagtgagtctgattttgtttcagcaaaattttatttaccaaaacagacaatgagtgggctggatttggcccatgatccttagtttgccaactcctgctttgggctcacccagatctgattttgaattctggctctgctactggttagctgcaggagcttggaaggctctctgagcctgtttcctcatctgtaaaattaaagcaataatttctaacactcaagagtgttacctcacgcctgtaatcccagcactttggaggctgaggcaggcggatcacctgaggtcagaagttcaagaccagcgtggccaacgtggcaaaaccctgtctctactaaaaaatacaaaaagtagccgggcatggtggcgcgcatctgtaatcccagctacttgggaggctgaggcagggatactgctagaacctgggaggtggagcgtgcagtgagtggagatcacacctccacactccagcctggccgacagagcgagactccatctcaaaaaaaaaaaaaaaaagagtgttagaaggttttgagataatgaataaaagatgccttgtgtatactaagtattcaacaactgatagctgcattggtctaattataacagtttagaagcgattgagtcaacaaatgctggatttgtcagggaggacttcctatcaggaggtagatcttgggctgagtcctgaagcaaagataggcattggatagaggagttgagagaacaccctaggactgttattattattattcgacacggagtctcttgctctgtcacccaggctggagtgcagtggcgcgatctcggctcactgcaacctctgcctcccaggttcaagcgattctcctgcctcctaagtagctgagactacaggtgtgtgccaccacacccggctaatttttatatttttagtagagacagagtttcaccatgttggccatgctggtctcgaactcctgacttcaggtgatccacccgcctcagcctcccaaagtgctggaataacagatgtgagccaccgcacccagcccagaaccatttttcaatccttggctctgccttttattagctgcaagatctcaggcaatttatttaacctctccaaagactcattttctcattcacaaaatgaggcaaataataatatctactatcccaggttgtcatgagaattaaatgcaacatgacatttaatgaaatgagaagtcccttggacattaactggctaaagtatgtgctcgacaaggatatcattttaggtggatacttagcatctcagaactgatgctcacaatggaatatcattgaaacgcattaaaattcattttaaatgattgtaggtagtgaggcaattgaaagaagaagacaagaggactgattataatgcttcaggctcactagtctccttttaggagggaaaaacaatttcaagttaaattttaggctctagatttttacccctgctgctcattagaatcacccagattgatgaaatcagagcccatctgaggctgtgtttttcatctccagaatgagagctgttgtggggattaagtttttgaaaaagtacatctaacaggtgatcgaaaatgatagtgatattattgcagtgatggtcattattgttgttattattatactgaaagaggcttcagttttctgatccataaagtgagggaattgcatgagaccattgctaagattccttctagctctgtttttttgtttttgttttttagacagagtctctgtcgcccaggctggagtgcaatggcatgatcttggctcactgcaacctccgcctcccgggttcaaatgatcctcctgtctcagcctccgaagtagctgggactacaggcacacaccaccatgcccagctaacttttatatttttaatagaggtggggtttcaccatattggtcaggctggtctcaaactcctgacctcaggtgatccacccgcctcggcctcccaacatgctgggattacaggcatgagccactgtgcccaaccccttctagctttcttgatcactgattctagggttctctgctgaaatatatttgagacatcctggataaaagatcatgcaagagctcccaatatggtattaataattgattctggaggcttagctactcctgatggattagacatgactcaactgcctctcttatgtgtacaacacaacaacacaaccaagaaaggttattctggcattccatttattcagtttatttacagcccttacttccagcagcacgttaaagatatggccagggccgggtgcagtggctcaagtctgtaatcccaggactttgggaggccaaggtgggcggatcacaaggtcaggagtttgagaatctggcaattcttcagacttagaagcaaccagctcgataacacagtcttgtgtgggctctccctctgtccctccctcgcttccctcatttctcatccctgcccctgagactgtgcaccttcacatagccctgccatgagaccttcatctcaggctttgctttctggggtaactgaggctaaacactgagtggccctaaaagaggattgggatttggaagttagattattcaccagagaacagactttgctgatgatcaggcccaggttgtaattgttgaaaaaaagagaggatgcatagtcttatctcatctcctagtcaaagtcaacaccatgataaataagagtcaaatcctgagatgtgaattggggacatttgagtggttaaccctgagaagcttgcaccttcagacccctcaatacccctgctccccagagaaggctggacattgacctcagcacaggcaggagccctgcaagatgccatttgtcctactaaagatggacccctccactctgtttctaggtaaataaccaaagtcaagtctccacacagcctgagcaagaaagtcagagcctgctacaggagaaaataccacactggccaaaggattcactagccctggccactgtgtgtgggaggaaccagggaatcatgtgtgggagtcaatgttgaagctgttggactgggggtggggtggaatataagcctggccctggggagtttttcccgtttgagggcctttacccacaactcaagatccagtgctatagcaggagatcccagagctagtcctaacagatggtcaggattgaacttggcctagagtaaaatgaggaggatagtgccagaactttctcaacatactattgaggaagaggtcagaaggcttaaggaggtagtgtaactggaaaggggtcctgatccagaccccaggagagggttcttggaccttgcataagaaagagttcgagacgagtccacccagtaaagtgaaagcaattttattaaagaagaaacagaaaaatggctactccatagagcagcgacatgggctgcttaactgagtgttcttatgattatttcttgattctatgctaaacaaagggtggattatttgtgaggtttccaggaaaggggcagggatttcccagaactgatggatccccccacttttagaccatatagagtaacttcctgacgttgccatggcgtttgtaaactgtcatggccctggagggaatgtcttttagcatgttaatgtattataatgtgtataatgagcagtgaggacggccagaggtcgctttcatcaccatcttggttttggtgggttttggccggcttctttatcacatcctgttttatgagcagggtctttatgacctataacttctcctgccgacctcctatctcctcctgtgactaagaatgcagcctagcaggtctcagcctcattttaccatggagtcgctctgattccaatgcctctgacagcaggaatgttggaattgaattactatgcaagacctgagaagccattggaggacacagccttcattaggacactggcatctgtgacaggctgggtggtggtaattgtctgttggccagtgtggactgtgggagatgctactactgtaagatatgacaaggtttctcttcaaacaggctgatccgcttcttattctctaattccaagtaccaccccccgcctttcttctccttttccttctttctgattttactacatgcccaggcatgctacggccccagctcacattcctttccttatttaaaaatggactggggctgggcgcggtggctcatgcctgtaatcccagcactttgggaggccgaggcgggcggatcatgaggtcaggagatcgagaccatcctggctaacacggtgaaaccccgtctctactaaaaatgcaaaaacattagccaggcgtggttgcaggtgcctgcagtcccagcggctcaggaggctgaggcaggagaatggcgtgaacctgggaggtggaggttgcaatgagccgagattgtgccactgcactccagcctgggtgacagagcgagactccgtctcaaaaaaaaaaaaaaaaaaaaaaatagctgggcatggtggcgcgtgcctgtaataccagctactctggaggctgaggcaagagaatcgcttgaacccagtaggcggaagttgcagtgagccgagatcttgacactgcactccagcctggtgacagagtgagactctgtctcaaaaaaaaaaaaaagaaaaaaaaagacagaaagaaagagcacagacagagtcacaggtatttgcagtaggaagctgtcaggttagagtgcacggaaatagaaagtatattttacacttacagcacatcttcgtttgattagccacatttaaaatactgaatagcaacgtgtggctatttagtattcactaaaatcttggacagtgcaagtctaaagaatccttgatccgtccggcatggtggctcacgcctttaatcccagcactttgggaggccaaggtggaaggatcacttaaggtcaggagttcgagaccagcctggccaacatggtgaaacctcgtctctactaataatacaaaaaaaattagccgggcatggtggtgcatgcctgtaatcccaggtacttgggaggctgaggcaggagaatagcttgaatccaggaggcgctgcagtgagccgagatcatgccatgccactactgcactccagcctgggcaacagagtgagactgtctcaaaaaaaaaaaaaaaattgttgggcgtggtggctcacgcctgtaatcccagcactttgggaggctgaggggggtggatcacctgggttctggagttcgagaccagcctggccaacatggtgaaaccccatctctactaaaaatacaaaaattagctgggcgtggtggtgggcacctgaaatctcagctactcaggaggctgaggcaggagaatttcttgaacccaggaggcagaggttgcagtgagccaagatcgcgcctctgcactccatcctgggtggcagagcaagactatgtctcaaaaaaaaaaaaaaaaatacttgattgtctggacattctgcagaacatcatatggagacactatgttgacgacatcatgctgattgtaagcaagaaatggcaagtgttccagaaacacagtcaagacacatacatgccagaaggtgagatataaactctactaagattcagtggcctgccacactggtgacatttttaaacctgctagatgtttgtgtagaaaaggatttaaccttgcccaaagaggggtctggcctttgtccccagctactggacataatctctttaaactcttgaaatatcattcctgatagaagtatttttgttttgactaggggccttgggccagccagatagcaacaatgtgatctgggttgggggctttggatcaggtggcatcagtgtgacctcctgagtggctagagactagaatcaaccacatgggcagacaacccagcttacatgatggaattccaataaagactttggacacaagggcttgggtaagctttcctggttggcaatgctctatactgggaaacccattctgactccatagggagaggacaactggatattctcatttggtacctccctgggctttgccctatgcatttttcccttgtctgattattattattattatgagatggaatctcgctctgtcacccaggctggagtgcagtggaatgatctcaactcactgcaacctctgcctccccggttcaagcgattttcctgtctcggcctcccgagtagctgggactacagatgcataccaccacacccggctaatttttttgtatttttagtagagacggggtttcacgttagccaggatggtctcgatctcctgacctcatgttccgcctgcctcggcctctcaaagtgctaggaatacatgtgtgagccaccgcgcccagcccccttggctgattattaaagtgtatccttgagctgtagtaaattataaccgtgaatataacagcttttagtgagttttgtgagcacttctagcaaattatcaaacctaaggatagccttggggacccctgaacttgcagttggtgtcagaaataagggtgctcatgtgtgtaccatgccctctaattttgtagttaattaactttcacaactttattattaccgcttacactcaatgtttattcacatttatccacataccacttattctagtgccttgcatcaaagactttctatctcatgtactttattctgcttgaagtaaatcctttaggatattcttttttttttttaaactttgcacatacatacttttattttttatttatttttaattttgttatttttgtgggtacgtagtagatatatgtatttatggagtacatgagatgttttgatacaggcatgcaatgtgaaataagcacatcatggagaatggggtatccatcctctcaagcaatttatccttcaagttacaaacaatccaattacactctttaagttattttaaaatgtacatttaattttgtattgactagagtcactctgttgtgctatcaaatataattttttttttttttgagacagagtctcactcagtggcccagactgaaagtgcagtggcacaagctcggctcacttcaatctctgcctccctggttcaagcgaatctcctgcctcagcctcccacatagctgggattacaggcacacaccaccatgcccagctaatttttatatttttttagtagagacgggttttcgccatgttggccaggctggtcttgaactcctggcctcaaatgatctgaccacctcagcctcccaaagtgctaggattacaggcatgagccaccacacctggccaaaatagaatattctttagtgaggtctgctggtgacaatttttttcttttttttgagactgagtctcgctgttgtcagcttgggctggagtgcaatagcacgatctcagctcactgcaacctccacctcccggattccagcaattctcctgcctcagcctcccaagtagctgagagattacaggcacccaccaccacacgcggctaatttttgtatttttagtagaaatgggggttcaccgtgttggccaggctggtctcgaactcctgacctcaggtgatccacccaccttggcctcccaaagtgctgggattacaagcatgagccaccacgcacagccaattttttccgtttttgtctgaaatcttattttgtgtcatctttgaaatatatttttgatggatataaaattgttggttgatagttattatcattattattattattttgagacagggtctcactctgttgcctatgctggggtgtagtaatgtgatctcggttcactgcagacttgacctcctagggctcaggtgatcttcccacctcagcctccctagtagctgggactacagatgcatgccaccatacccaactaatttttctattttttgtagagatgaggctttgccacatttcccaggctggtctctaactcctgagctctagcaatccacccaccttggccttacaaagtgctgggccatgactagccagcagttactttttatagcatattgaatatttaatatgaatcttctggcatccactgtaactgtttaaaaaatcagctgtttacttggcactcttttttttttttttttttttgagacagagtcttgccctgtcgcccaggctggagtgcagtggcgtgatcttggctcactgcaagctctgcctcccgggttcacgccattctcctgcctcagcctccggagtagctgggactaaaggcgcccgccaccacgcccggctgatttttttgtatttttcgtagagttggggtttcaccgtgttagccaggatggtctcgatctcctgacctcgtgatctgtccgcctcggcctcccaaagtgctgggattataggcgtgagccaccgcgcccagcctcttttttttttttttttagacggagtcttactctgtcatctaggctggtgtacagtggcgtgatctcagctcagtgcaacctccacctcctgcctcagcctgccaaatagctgggattacaggtgcgtaccatcacgcccggctaatttttgtattttcagtagagatggggtttcaccatgttagacaggctggtctcgaactcctggcctcaagtgatctgcctgccccagcctcccaaagattacaggcatgagccaccgcacccggccaagtagcactcctttgaaggtaatctgcttcccctacccctagcaatttttaacaatttttcttcatttttatttcctgaagttttgttattaataatctgtgtgcagatttctttgtatttcttttgtttgcagttcatagtgattcttgaattagtgtgttggtttctgttatcaccacaggaaaattgtcagccgttagcttttcaaatatttccttgctaaattctctcttctcccctttcggtacaattgatttgattaaaactaaaaccagggccgggtgcagtgactcatgcctgtaatcccaacactttgagaggctgaggcaggtggatcacctaagctcaggagttcaagaccagcctggccaatatggtgaaaccccgtctctactaaaaatacaaaaattaccaggcatggtggcacacatttgtagtcaggaggctgaggcaggagaattgcttgaatccaggaggtggaggttgcagtgagctgagatcccaccactgcagtctggcctgggcgacagagtgagatgagaatctgtctcgaaaaaaaaagttatgaatgtttgataaactatatttgttagaatgtttgttgtagaatactattcattgatttttaaacaatgttagattaaaccattcactggatttgtgataattaacttactgattttacctcactgatttgttgtaattaatacaactggtataaaaagactgtgacgaggccgggcatggtggctcccgcctataatcccagcactttgggaggctgaggcaggcggatcacctgaggtcaggagttcaagaccagcctgaccaacatggtgaaaccccatctttactaaaaatacaaaattagccggtcgtggtggtgcatgcctgtaatcccagctcttcgggaggctgtggcaggagaatcacttgaacccgggaggtggaggttgcagtgagccgatatcgcgccattgcactccagcctgggcaacaagagcgaaactccgtctaaaaaaaaaaaagaaaaaaaacacataaaacaaaacaacactgtgacggttcccaaaaattaggagcataattaaaggaactcctgataaaaattaattttatcttacatgtaaactaaaatgactttatgaagttaattcagaaatacaatgcagggtattagtttgccacagctgcgtattcagcctaatgtaatattcttgttatttttaaattcttcttttaactttactcatatgtggatcatcaaatttcaaaagattaaatgacaatactcttagcagcaagcttccctaagcatataaacattttaatgggtgatgattcagaaggtacccgaagaatatgtactgccagatatcattcacccccatatacctgcccgacagacatcccattttgggaccctggataaatgtgtgggtggagagaaagataggagaaagtggtataagcaaatggctttggagtctgattgacagcgattgaaatcctgtctctacctcttaacagcctcatgatcctacataagttaccccgatcctcagggccacatctgtaaattgggggttgcgatggcagccatctcacagggtctcttttcggggaagggcaggaattatggattaagtgagctagtaattgtaaagcacttaatacaaggagggcgcataataagtacttcataaataatgacggccattatcatgactgaggtgtatgcagctgtcggggattacggcgacttcagaatttctggtgggcagggctcaaaggcagcaaatcacactggaagtcgaggtgaggcactgcttctgcacagactgcttagctggagagaatgaggaaggcttagaggagatttagaggaacttagagtcctccgcctccaactctgtgggatctgctcccgtgccagagacattcaggggatttctcgcactctcccctcccctacgtccctcccgccccatccaactaaccacacaacacatacaaaatagcccctgcgaggttctgcacgctggaagggaacaggagaagggcgctgcgctttcttgctgatgccctgtacttgggcccctggtagacacagccacttgtcccctcagcctgcagagaaatcccacgtagaccgcgcccgggtccttggcttcagccaatctccctttggtgggggtgggatgcacgatccaaggttttattggctacagacagcggggtgtggtccgccaagaacacagattggctcccgagggcatctcggatccctggtggggcgccgctcagcctcccggtgcaggcccggccgaggccaggaggaagcggccagaccgcgtccattcggcgccagctcactccggacgtccggagcctctgccagcgctgcttccgtccagtgcgcctggacgcgctgtccttaactggagaaaggcttcaccttgaaatccaggcttcatccctagttagcgtgtgaccttgagcagttgactttatttttcagtgcctagttttccagataccaggactgactccaaggactattactcatctggagggtttagcacagtaccgtcgcatagtaaatttccatgtcagttttggttacctttcatgcacttgcaaacatgccatgctctgaaacgaaataggcacatcttttttttttttttttttaaggagtcttcctctcgcccaggctggagtgcagtggcgcgatcttggctcactgcaacctccacctcccgtgttcgagattctcctgcctcagcctcctgattagctgggactacaggcatgccacgacgcccagttaatttttgtatttttagtagagacggggtttcgccatcttggccaggctggtctaactcctgacctcaggtgatctgactgcctcagcctctcaaagtgttgggattacaggcataagccactgcatctggccagaaatgaaataagtaaatcttttaacctgctctaacaatatagtgaaaagaccatattattattagagcaggttaagggatttgcctatttcgggttctagttatagtcttaaacttggacattcttgtagaaagtaaaaagtttcctcttcaaagttccccttcttgttaaagaatacatcataagtgttagaagtaatagtttattttaaagactaactttcttcaagcctccttgctttgtgctaataactctttgttaagccctatcctatgtaactgttggacatgctcacaggcacgttccagttcacagcctatgccccttccttatttggaaatgttattgcttccttaaacctttcggtaagcaacttcctctccttcttcgttcttccttgcacttacctatttagaaagttttaggctattagcaaatcggctatcagtttaagagtgtgaggtcccgctccagccaatggatgcaggacatagcagtgaggacgacccaaatgcgtaagggataaatatgtttgcttttcctttgttcaggtgtgctctcgacatcgttccatctgcgattgagcaccctttctgcagaaagtaaagattgccttgctggagatcttttgtctccgtgctgacttttcttcgtggcaccgattatctatttctaacaattttggtatttctaacattctgaacaatcttgggctagttgtctcttctgggcctgtttccccatccgtcacatgataaacttcattggtttaaaaaccccagcgaacatttattgagttactattaccttcctgccctccccaaccccaaccccagggagcagttacaacctcagccgctgagcgcactcgccgggtgttaagaagcaccaaagacagggaggcttgattgattttgctttgggagtagagggtcagaagattcacaggaaaatggcatttgagcaaggatgattcactggagctagcttttaaatactggcgaggcttttatgttgcagtcccttacaaagttgagcattcgcagggactgcactccgaaataagcccgcttccccttttcattcgctaatgatccagggagctgctggttccgcatgcggcaggttgtgccttttcctaatcagggttctgcatcgcctcgaacccgcaggccgtggcgggttctcctgaggaagcagggactggggtgcagggtgaagctgctcgtgccggccagcgcctgtgagcaaaactcaaacggaggagcaggaggggtcgagctggagcgtggcagggttgaccctgccttttagaagggcacaatttgaagggtacccaggggccggaagccggggacctaaggcccgccccgttccagctgctgggagggctcccgccccagggagttagttttgcagagactgggtctgcagcgctccaccgggggccggcgacagacgccacaaaacagctgcaggaacggtggctcgctccaggcacccagggcccgggaaagaggcgcgggtagcacgcgcgggtcacgtgggcgatgcgggcgtgcgcccctgcacccgcgggagggggatggggaaaaggggcggggccggcgcttgacctcccgtgaagcctagcgcggggaaggaccggaactccgggcgggcgggttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaaggtagctgagggggcgccggcggggagtcaggccgggcctcaggggcggcggtggggcaggtgggcctgcgagggctttccccaaggcggcagcaaggccttcagcgagcctcgacctcggcgcagatgccccctgagtgccttgctctgctccgggactcttctgggagggagaaggtggccttcttgcgcgaggtcagaggagtattgtcgcgctggttcagaagcgattgctaaagcccatagaagttcctgcctgtttggttaagaacagttcttaggtgggggttagtttttttgtgtttctttgaggaccgtggatcaagatcaaggaaatctctttagaaccttattatggaagtctgaagtttccaaatgttgagggttttatgtctaaaagcaacacgtgaaaaaattgttttcttcacccagtgctgtcttccaatttcctctttggggggaggggtagttactgctgttactaaaataaaattacttattgctaaagttccccaacaggaagaccactacttttgatgactttggcaagtttgctaactactggaaccctaacttacaaacgaactacttacatttttgatttccagttgtattacctgcccaatgtttacgtagaaacagcttaattttgattctgggtaacgttgttgcacttcattaaaaatacatatccgaagtgagcaagtatgggtctgtggacagcagtgatttttcctgtcaattcctgttgcttcagataaaatgtaccagacagaggccgggcgcggtggctcacgcctgtaatcccagcactttgggaggcttggcgggtggatcacctgagatcgggagttcaagaccagcctgaccaacatggagaaaccccgtgtctactaaaaatacaaaattagccagggtggtggcgcatgcctgtaatgccagctacttgggaggctgaagcaggagaatcgcttgaacctgggaggcggaggttgcggtgagccgagatagcaccattgcactccagcctgggcaaaaagagcgaaactccgtctcaaaaaaaaagtaccagacagaaatgggttttgttttctttttttgttttgagacggagtttcgctcttgttgcccaggctcgagtgcaatggcgcgatctcagtctcggctcactgcaacctctgtctcccaggtttaatcgattctcctgcctcagcctcccaagtagctgggattacccatgccccaccatgcccggctaatttttgtatttttagtagaaacggggcttcaccatgttaggctggtcttgaacccctgacctcaagtgggcctcccacctcggcctcccaaagtgccaggattacaggcatgagccaccgcggccagccagaaatgggttttggaaaaagcactaaacaaaatcgaacttggtttcatatgacagctctgctgctaactgtaacaggggcagaccagttaacctacttttctgtcttctgtcagctgagaattagatgattcccaaaggcccattgaactctgaatgactttaaatacttcttcttaagtgggtacacggttttggtaactgatgccaggtgatgaatgcatgaaagtgcttaatgaatgaaaccggtaaaatagtaggaggaagctttattggtaaggcaggggtatacctaatagctctctaatttattggtattgaagtggttaacttttgtttttttaaggggggaaaacattctaagaataatgaggcaaactgcatattgcacaagagactgttgtctctattcaacaaataccttttgagtgtccagagtctgccaggtgctgtgctaggccctcacgattgagtagtgaaccagagaatgtccctgcacccatggagcttattgtctactggggtagacagataataaataagcaaacaaatcttctctcttctccctttcgctccatgtaagtgtgtgtgtataggtgtatacttacaagttgagtaaagtgttatgaaagattaagaggagaaatgcattttggttagatgttagaggactcagcaggtgaccttgaaacttagagctgaaggatcagtaggaggtaactagagaggccagggaatcgcatgttcaaaggccaggaggcaagaaagagcatggtgcccttcaagagaggaaagaaggctactgtgactggagcatagatgtaggcaagtgttgggtgattgagagctctacgggccatggttaggttttattcctaatgccgagatgccaaacatggtggttcatatctgtaatcccagtattttaggaggccgaggcaggaatatagcttgaacccaggagttcaagaccagcctgagcaacatgagacctgtacaaaacatttaaaaaattgctgggtatgatggtgcacacctgtggtcccagctactcaggaggctgaggcagaaggatcacttgagcctaggaggtggaggctacaatgagccatatttgagtcactacactccagcctggatgacaaagtgagaccatgtgtcaaacaaaatacagaaagaatattaatttaaaattttgaaagaggagtgatctgaacttatatcttaaaaagatcattctagggcatggtggctcatgcctgtaatcaagggctttgggaggctgagacaggaggatcacctgaggccagttcgagatcaacctgtacagcatagagagactccatctctacaaaaagaaaaaataaatagctgggtgttgtgagttattcaggaggctgaagcagaaagatcacttgagcccaggagtttgaggctgcagtaagctatgatcccaccactgcaacacagtgagatcttgtctcaaaaaaaaaaaaaaatcattctaggtgctttttggaggctggatgtggtaagagtagaagctggagatggtcctgttagggattcgattcagactttaaataccatcaatgcattgagtcccaaatttacatcactacgttggatccttgcccctgaatccagactggtatatccaactttaggttcagtttgtatctctacctgaccaatatagaggtgtccagtcttttggcttccctaggccacattggaagaagaattgtcttgagccacacatagagtacactaacgctaacaatagcagatgagctaaaaaaaaatcgcaaaacttataatgttttaagaaagtttacgaatttgtgttgggcacattcagagccatcctgggccgcgggatggacaagcttaatccagtagataccttcaacttacaatatctaaaattttatgccagatttagtcattttaaacctgctcatcagtttttctcaagaagtagtattttggctttttttcttttcttttttttgagatggagtttcgctcttatcgttcaagctggagtgcagtggcggatcttggctcactgcaacctccgcctcctgggttcaagtgattctcctgcctcagcctcgcaagtagctggaattacaggcatgcgccaccatgaccagctaatttttggagacagggtttcaccatgttggtcaggctggttttgtactcctgacctcaggtgatctgcctgcctcggcctcccaaaggctgggattacaggcatgagccaccgctcccggctgcatttttggatttttagttgctcagcccaaaactttagtacatctttgaacctcttctttcctcctactctatatctgatccatcagcaaatctgttaggtctacctcacacatatcgaaatcctaccacgtctcaccatctgtgacaattaacaccctggtctaggcagtcatctctgttaagattgagtggttaaggatgtcctctaaggagatgacattcaaatcttagcttaaatgtcaagagggagctggttttataaagattgaggaggcagcattattttgccataggcttccatttggtttccattccattcttgatacttatggtatatattcaaaacaaatgcacagaaacagacccaggtatattgggaatttcggatatagagttcctagttgggaaaagatagactgatctgtaaatgatgctagttatccatcatctggcaaaaaataatttcctgcctcctctcatatatctcagatcaacagactttttctgttaagggccaaatcataaatattttaggctttccagaccatatggtttctgtcacactctcctttatccttgaagccatagacaatatgtaaacaaatgggcatggctgtgctacgataaaactttacttacaaaaactggtagtgggccagtttaggcatggccagcactttgggaggctaaggcagatggatcacttggggtcaggagtttgagaccagcctggccaacatggtgaaaccctgtctctactaaaaatacaaaaaatagctgggcatggtggtgggtgtctataattccagctactctggaggctaagacacaagaatcacttgaacccaggaggcagaggttgcagtgagctgagatagcaccactgcactccagccagggtgacggagtcttaaagcaaaacaaaacaaaaggtagtgggttgtatttggcccatgggctgtagtttgccaatccctgatgcagaaacaaattccaggtaaataagagcctggaatgttaaaaaaacaaaacttgaagtcatgtagaagaacaggtagggggaacaatcctgatctcaggataggaagggatattgcttaaaataagacacaggaaaatataatccatgttgtgtaaatttgactacgttaaaacttaaaactttcgccaagcgcggtggctcacgcctgtaataccagtactttgggaggccgaggtgagcagatcaccaggtcaggagattgagaccatcctggctaacacggtgaaaccccgtctctactaaaaatacaaaacattagccgggcgtggtggcgggcgcctgtagtcccagctacttgggaggctgaggcaggagaatggcctgaacccgggaggcgaagcttgcagtgagctgagatcgcgccactgcactccagcctgggcgacagagtgagattccgtctcaaaaaaacaaaacaaaacaaagcaaaaaacctaaaactttcatacaataaagtatacctaagatacttctagaagagaagatttacatccaggacgtgtatggaatttctgcaagtaataagtaaaagacaagggacatgaagaggcagttcacaaaagaggaagccaaaatgaccaataaacatgaaaggatgtttaacctcaaaggaaacaaggaaatgaattaaaaacatcaaatgccatttcaaaactagtaagttggcaaaattaaaaataccaaggatgagaatatgaagcatggctatatgagtgcatggaatggtacagtcactttcattaaaaatgcacataatttgttttttatttatttttttgagacagtctatgtcgcccaggctagaatgcagtggcatgatctcggctcaccacaatctctgcctcctgggttcaagcaattctcctgcctcagcctcctgagtagctgggattacaggcacatgccacaacgcccggttaagttttgtatttttagtagagacagggttttgccatgttggccaggctggtctcgaactcctgacctcaggtgagctgcttcccaaagtgctgggattagaggcgtgagccaatgctcctggctgaaaaaaatgcacataatttgttacctagcaattccatgtctagaggcttatcctagagaaattcttgcttatatgcataggaagacgtgtactagaatgttcactagttgaatgtttaagtgaaaattaggaaataaagtaaatgttcattaacaggaaaatgagtaaaggtatatttataaaacaattaagtagctaaaatgaataaactagagctgcgtgaatgaactagaactggttcaatagtcatgtcagattattgaatgaatacaggtcagatatgtatagagtgtcatttgtgtaattaattttttttttttttttgagatggagtctcactctgttgcccaggctggagtgcagtggcgtgatctcagctcactgcaacctccacctcctgggttaaagtgattctcctgcctcagcctcccgagtagttgggattacaggcatgcaccaccatgcccagctcattttcctatttttagtggccacagggtttcaccatgttggccaggctggtcttgaactcctgacctcaagtgttccacccaacttggcctcccaaagtgctaggattacaggcgtgagccaccgtgctcagccatttgcgtgatttttaaagatgtgcagaataatgccattaaaaaaaatacacatacatgtatatatatacacgtttggctgggtgtggtggctcacacctgtaatcccagcactttgggaggctgaggcaggaggatcacttgagcccaggtgtacaagactagcctgggcgagatagcaagaccccatctcaacaacagaaaggataattaggtatggtggcatgagaggatcacttgagcccaggagttcgagtgttatcaggccactgcactctagcctggacaacaaagcaagaccgtgtctcaaaaaaataaaaataaaaagtatttgtatgtggtcatagtcaaaaaacgtacatggaaggaaaatgtctttatttatttatttatttttttttttttaagacagagtcttgctctgtcacccaggctggggtacagtggtgtaatctcagctcaccgcaatctcggcctcccgggttcaagcgattcttctgcctcagccttctaagtagctgggactacaggtacccgccaccacaccctgctaattcttgtgttttcagtagagacagggtttcaccatgttggcaaggctggtctcgaactcctgaccttaagtgagccacccgccttggcctcccaaagtcctgggattacaggtgtgagccactgcgcttggccaggaaatatctaatttagtaagtatttatatctgggaaaggaagggtcaggtggtgattcataggaactctaaagtctatgtataatacttagggggacagaaggaaataaagcaaaatgctgatatttgattgttgagttgtgtatatgttagaagtataacataggagatctgattgatagtaggagaatgtttttaggtggtaaaagtggaaccgtggtggtttgttttggcagtagaatcagttggtcatagtttgtatgtggaaggtaataaacagaccatgttaaggatgacttccggaattttggtctgagtagtgggtggatgacagtgtcattcatgagggaagatgaagactgaggtaggaacaggtttgggagaagatgacatgttcccttttagacaagtggaattatggaagatggcaggtaggtggttagctatatgaatttgagataaaagatttaggatggagatataaatttaggagtaacagcgtatctatggtattgtaagccttaagaatgggtaggatcagccaggaaatacagatgtatatgcagaagagaggagtcaaggaagccaagacaagttaatgtttaaagtgagtgatgtagtccatgggcagatgctgctgagagggctgcaaacaccagtgaccctacaacatttttaaatgtcgtcttcctgacagcagtgatcagtacctgcaacgatcttatttatttttttcatgttagtctccacacacttgaatgtagactttttgaaggcaaaatcattgccttttctgagctgggagcatgtctggcacataccaagcactcaacagttgatgtattgacttcatccagatactctgagggcgagttatttcctgctactagcctttcacctttcaatgtttaagagcacaaatacagagatgggcacgttttggcatttcttattttgataaccttttcctggtaagattttttaatgttgaaaaaaaaaaacaagaaaagagggttaaaaatagtcttatgtcagatcctgtgatagaattcacacttggcttaagctgctgggcaccttcctatcttggatgtcatattagcttatctacagcagaatttttactgttttatgtagtaaggaagcaattatatgattattttacagacaaattattctttatcttttatttttttagacggagtctctctttgtctcccaggctggagtacagtgtcgcgatctcggctcactgcaacctccgcctcctgggttcaagcaattctctgcctcagcctcccaagtagctgggcttacaggtgtccgccaccacacccagctcattgttttgtatttttagtagagatggggtttcaccatgttggccaggctggtcttgagctactgacctcaggtgatccacccgccttggcatcccaaagtgctggaattacaggcgtgagccaccgtgcctggcccagacaaattattatactctgagtgttagaggcttaggatgttttcacttgatgctatgggaggaataagtaataagatatgatacacaaccaaagacctttcttcactatgcttctagtagctagtactatggatgacacatggtaataatattggttagcatttgtcctcaatttactgtgctagttactcttctaagccccttacaggtatatattttttttcatcaataatcctctaaggtagtttttattattgacctaattttataaatcaagaaaattaagacccagagaagtaagtaacttgtccaagatcacatggcttataagtggtagagccagaatttgaccccagatgttgtgactacattgtctctccataagcaggttcaactcttttgactggatgctgttccaaggtcacttccttagagaagcctttgctgacaactaccctcctgtgccctcctccaaggctgtccattgttctagaactttgaatactcatcttagaataaagctggtctaatttttacagtgttatagaatggatctctgactgcaaaagttggtcataattatctttttatgttctagtgaaaggcaaagaacaagagaagacctcagatgtgaagtccattaaaggtaagttctgcccttggcagtccactgcattaaaaagtgatgtgctttgcatttgtgagttctttaatcctgttatactctctcttttggcattaatcatttctgccttattttataattacttatgattttgatttatttccctctttaacctgtataatgctttaacatctagcatataataagtaggctttttttttttttttttttttggagacggagtcttgctctgttacccaggctggagtgcagtggcgcgatcttggctcactgcaagctctgtctcccgggttcacaccattctcctgcctcagcctccccagcagctgggactacaggtgcacggcgccacgcctggctaattttttgtattttttagtagagacagagtttcaccatgttagccagtatggtctcgatctcctgaccttgtgatccgcccgcctcggcctcccaaagtgctgggattacaagcgtgagccaccgcacccggccgtaagtaggctttttttaccttaattttatttttttgagatggagtcttgctcttatccccaggctggagtgcagtggtgccatctcggctcactgcagcatccacctcccgggttcaagcgattctcctgcctcagcctcccgagtagctgggattacaggtggccgccaccatgcccagctaatttttgtatttttagtagagacagggtttcaccgtgttggccaggccagtctcaaactcctgacctcaagtgatccactcgccttggcctcccaaagtcctgggattacaggcgtgagccaccatgcctggccataagtaggcttttactgagccttgtgtgtattggctatcctagtgattacagtgaaccagtgcccttcttattaatcacacatttaattgttccctaaaagtgattagttcactttatttatttagtaagacaaaaaatgaagaatactcttaactgagcagtctgttaactgtaggaaagcactgacacttataaggcttagttttctgtcatttatccagaagtatggttgattacagtttttacttttttatttgaatgaacaaccttaatttaaaatatattttgtttattttttgttgggatcgatacattgtccttgtttatagattagagcatgctttttaaagatgctgtattactcactgattttatttgtccagtgtacagagattgaagtgggaaaattataatggaaattgtttccatagtcattacatattaatttcatcaatttatttccataaaatctgtagattgctacttatttagatttttccttcaaatgtttttatgttgtattgcttgcactgagtatttattctatatgctcaatttgctggagaagaagactaattataacttaggcaagttgtaaaattagggaaaaaagtaaggtaccttacagcctagtttacttatttcttatgtaaagccagttagattccacattagttcaaactgccttctttgagcaaaacttgattggcagtgataaaggcttaaagcccttctcaagcagagacctgtaaagactagatctgactgtagtagaaggaaggaacttagatgtttcaggcagtgagaacaccagtcttccactctaaactttgccactaacagtatgaccttgggaagttgtaactttcttcagattcttcatttgttgaatggggggattggcctagctaatttctaaatctctactgggctaaaaaattctgtgcttatactctgattatgaagtacataatctgtgcttaacattcactgacttatccttaggataatacagaagcagtacaagaaacagcccctcaagatgtttgcagtctggttagaaagacaaacttatacacagaacagtagcaaatagaccaaaataataatagctgccatttatagaacacttcttctgttctgggcattagacaaaaactgactataacggtgaacaaaaaagacttaggtcctgccctcattgaacttacagattagtaggggagaggaacattaatcaagtaattccacagatggcttagcctagattggtagtgatggaagtaaagagatgtgaacggacttgaaaaaaaattcggaggcaaaatggatagaagtttattattgattaaatatgaggtgtgagagagagggatatttaagattgatacctaccttctggcttgcctaacagaaccaaaacaggaaattatatgttcagttttgttatgttgggtgggaggtgcttttgagtcattcatttatatatgttatatatgttattttatatgcatagtaattttaaggtctgagttttaaaccaaaggttagagagtgattttttagagtctagcaaacctaagttgaaatcctgcctgttgaaatggctgtttactagctcattaacctagggcaaagtattcaacttgttttcatttttgtcttcatctctaaaatgaggaaaatatggtcttacaagattgtcctgagagatagatgaaataatatccaaaaaaaaaaaaggtacatagagaaactcgtatagtgcctggtatatagtaggtcctccattggtagctatcattatctagttttaacatagccttcagtttgttgaattagtcaaactgagtgaagcactgcaaggaattcagaggaatttgagatcaacaaatgatttctgaagtttagggaagacttcatggcaatgacacttaccttgtataaaagttgaagaataagaaagatttgaatgagagattctttctcttctccctaccagcccagcttcttatttgaggatatattgggcaaaggggccttcagacaagtagagggagatttttacagaaagattgagatgaaggtatagaaggctgtaaagaccagaaaagagaattgagacagaggaagcaggaagccactgtaggtttttgagcaagatattgatgctgtaagtatggtgtttatgaaaggttagtctggaagagatttgcaggatggagaccccggaagtttttttgttataatacagaaagacttgcactgagggtgaggtgttaaaaataaacaggtaagtaaatgtttaaacatcttgaaggaaaagtcaacaaatcttggcaagtaaacagataacagtgaaaaagaatgggaccaagattttgagttttggagactggtggattgaacagacagggaaattgagaggagaatcagatgatgatgttttaagttgatatttagacagattgtgcttgagatggtaaagtcaatgtgggtgggaatgcttagtagcgagtaatcagtgatacaagaccaaagcccaggtcaaagacaagtcacagatacagatcagggctttttcatctgctccacagaggtgtaccctaggagctgttgcaaacagtccatgtggagggtgtgagtaagatgtttcccttgaatttgccagaattacttttttgttgttgttgttgttttttctgagacagattctcgctctgttgcccaggctggagggcagtggcgagatcgcgcagctcactgcaacctctgcctctcgggttcgagtgattctcctgcctcagcctcccaagtagctgggattacaggcttgtgccaccaagcccagctaatttcttttgtatttttagtagagatggggtttcaccatgttggccagactggtctcgaactcctggcctcgtgatctgcctgcctcagcctccaaaagttctgggattacaggcgtgaaccactgcacccggtcccttgttaagtttattttggtgggaagcaaaggaggtttcagcttttaaaaagtttgaaaattattgctctggtaataattaaagatttgagagtaaatatgctttctagcagaaagaataaaagaagaacagatagcctcaagaaggggagccaaagaagcaggctatatctgacacactgggtgttgataaatgggtattaaaagaatgagagcaatgagcagatagaagaggaaattaggagagtataataccatggagaccaagaaagatagactatcaggaaggagtggtaaaaataagttactagttctaagagagatgttaagagggaccggggaaagccttgtacaaatgagttagtagcattttacattatatacatctaattaagaaacaatgcgagagtctcaccattcctatagactcttacttgtacttgtctgaacacgaaaactggcttttgtttataaataagctaaaaattattttgctccaatttctcatgaaaataaaaataaaccttcttttaacattgaaaaaatagtttgaagacagtcactcttcattttgtaattcccacaactattattgaatgactgaaattatctttattctgaagccaaaggggtgatactgatatttcttcagactactaaaaatatattttatgaatttttagtgtgctttatctttttttgtttttttttttgagatggagtttcactcccgttgctcaggctggagggcagtggtgcaatctcagctcactgcaaccttcgcctcccagattcaagcaattctcctgcctcggtctcccaagtagctgggattacaggcacctgcccccacacccagctaattttttgtatttttagtagagacagggtttcaccatgttggtcaggctggtcttgaactcctgacctcaggtgatccacccaccttggcctcccaaagtactgcgattgcaggcatgagccaccatgcctggcctgaggaatatttttctaggttccccccaccccaagcatttattctgcaattttagttttgttcctaaagcaagcaaggtttaaggatttaaaaataatccgtattttagaatgctttctggctttgttactttttatccacagtagaagttctcagagaatgatctccctcttttaatttaactttttggcacagtattttgagaattataaataatattagaatgttttctggctgggtgtggtggctcatgcctgtaatcctggctacttgggaggctgaggcaggagaatcacttgaacatgggaggcagaggttgcagtgagccgaggtcatgccactgcactccagcctgggtgacagagcaagactctgtctgggaaaaaaaaaaaaaaaaaaaagagtgttttctttcctattttccaccacttgattaagttacttttcctcttaagtattttttgctgagtatgctgacttaagagtaatgttacaaaatttaatttttaaagttctctgaaagcccctttatgagagttttaggctatcaaattgtgtttaattcttaacaattttttgaaaaattatagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggtaagtaactatcattttttattaacttgtattagaaggatttgagtacaatatgtgaaacttctgtcataggatacagaactatataattggaaagtgctttggaaaaaatgtatttaaaataacagctacaagtataatgggtagctgtgttgtgttcctgtaaatatagaatataaagcatgcccagtagaaaaacaagcatttccagaagaaatatatctgatcactaaatataaatatatgaaaaagatgtctcactttattactgagggaagtgcaaattaaaataatcagttaatgttctcctaacacattagcatattttttaaagtttgacaatttgaatgtcagtgaagatgcagggaaatacccctcctatttagtgataatataatctggtgaagactctttggaaagcaatttggaaatcagtataaaatatgcatgtcatttaggccactctttctaagacctagccctcagatatgctcattcatatgtgcaggtgtgtatgtgtgtgtgtgtgtgtgtgtgtgtgtgtatatgtatgtatgtatgtatgtatgtatgtatgttgaaggctattcattatagtattgtttgtgatagcaaaaaattatggacaacatataaatatctgttatagggaaataaccaaattgtggtatacgcatgctctggagtataatatagccatttgtttctatttatttattttcttgagacagggttttactctgttgcccaggctggagtgcagtggtatgatcatggttcactgcagccttcacctcctgggcacaagccattctctcgcctcagcctccagagttactaggactgcaggcatgtgtcaccacacccagataattttttaattttttgtagagacagggtctcactatgttgcctaagctggtctcaaactcctggcctcaagcaattctcccacacaggcctcccaaagtgctgggattaccaacgtgaaccaccacacctggttcagtgtagccatttagaaatctaaaaaagacgtgggaaaatgtctaaggcatgtttaaatgtgagaaaagcaagtcacagtatgcatggtaaaatccgttatattaaaataagttcttccaaaacaaaaacatatgcaggagacctttattttgtcagtatttcttacccaaatttctgcacttagaaaattgcatgtcatgttgtcataagttgaaaaaaagatccatgaaccaatggacttctaataaaatcagtcctgcttttgacatctctctctacttttgtgtatattcaaaccagagtgtcaatgtgtttgtggggcacacttagcaataatacatagcagacaaaatgcatatagctcagagagtaaaattgtaagttttgctagatcactcataaattgctgatgagaatttaaaatggtgcagatgctctggaaaacaggcagtttctttctttctttttttttttctttttgagacagggtctcactctgttgcgcaggctggagtacagtggcgtgattacaactcactgcagcctcaccctcctcaggttcaggtgatcctccctcagtctcctgagtagctgggactataggcatgcaccaccacgcctggctaatttttgtattttttttttttttttttgtagagacggggtttcgccatgtttcccaggctggtctcaaactcctggaatcaagcgatccacttgcgtaggcctcccaaagtgctgggattacgggcgtgagctactgtgcctggcctaggcagtttgtttgtttgtttgtttgtttgtttatttatttgtagacggagtctcacaggctggagtgcagtggcccaatttttggctcactgcaacctccgcctcccaggttcaagctattctcctgcctcagcctcctgagtagctgggatgacaggtgcctgccataatgcctggctgatttttgtatatttagtagatatggggtttcaccatgttggtcaggctggttttgaactcctgacctcaggtgatcagcccgcctcggcctcccaaagtgctgggattacaggcatgagccgtcatccctggctggtggtttcttatgacgtgaaacatgcaattaccatatgacctagcagttgcactctgtatttatcccagataaatgaaaacttaccttccaataaaaacctgtgcacaaatgttcatagcagcttaatattgaaaaactggatgttcttcagcaggtgaatgaactggttcattcataccatggaataccattcagcaataaaaaggaacaaactgttgatacatttaaccacctggatgaatatcaagggaattatgctgtcagacaaaaaccagtccctaaagactacatatagtatgattccgtttggataatattcttgaaatagagaaattaagagaaatgaaaagattagtgtttgccagatgttagagacagggaggtgagaggggtaagtgggtgtagttataaaagtgcaacatgagggatctttgtgatgttgaagttgtatcttggcagtggatgcagaaatctcaatgtgataaaattacaaagaactaaaaacaagaatgagtatagataaaactggggaaatctgaacaagttagagtgttgtatcactgtcagtatcttagagtgatattgtactatagctttgcaagatgttaccatgggagaaactaaagtgtacaagggatctctaggtattattatttttttagagatggggtttcactatgttccccaggccggtcttgaactcctgggctctagtgatccgcctgccccagcctcctaaagtactggaattacaggcgtgagcgaccatgcctggccctttcagtattgtatcttagaacttcatgtgaatctagcattatctcatagaatttaattaaaagaaattgtaaacctcacagaagatcagaatttcctcaagtttgtgatgttgacaaagatgaactagttgacactgacagtaagactgaggatgaagacacgacgtgcttcaaaaaaatgatttgaatatcaatggattaagaagaactcttttgacaaattgatgaaaccctcagtcagttttataagaatgcccatctttatgatcatgctatgaaagccaatttttaaaaaaattttttgtctttcctaacaattagcttgtggttataatttaaatttagttaaatataagataaatgattttttattaagtttagtttcatttttcaaggtacgatctcaaagctactctttaacctactatgaatgaataatgctgagttcataacatctttgtagatatatccacaattttccctcaggataagtgcctacaagtggaattactggactgaaaataatgcagtttgctaagactttgctatctgttcctgaatgctcctccaaaaaggttttgccagtttacatcctcatgaccagcgaatgagagtgttgcctattttcctgtgcccttgttactgcttaataatttttgaaaaaaatctaatttgacagacaaaaatgcattttatgttaatttgcttttctgggatttttaatgaggttgagtatagtttttaatatttttattggcccctttggaactagtatcataagttttttttcttaagaatttatgtagtctgggctgggcgcagtggctcacgcctgcaatcccagcactttgggaggccgaggtgggtggattgccgaaggtcaggagtttgagaccatcctgaccaacatggtgaaaccgaatctctactaaaagtacaaaaactagctcagcgtggtggcgggtgcctgtaatcccagctacttaggaggctgagtcaagagaatcgcttgaacccgggaggtggaggttggttgcattgagccgagatcgcgccattgctctccagcctaggcaacaagagtgaaaagtctcaaaaaaaaaaaaaaaaaaaaaaaaaagaatttacatggtctgaattgccattaaaagagatatgagaattattgagtaacaaataactttttaataatttaggcaagttttggacgattgtactttgtttagaaaccaaaagcatagtatttgtagtttttttatttactttagttgctaggaagtaaactttattcaaggtctctggtaccagttgttgctaaaagtgattgactaatctgtcaatctgaaattatttgttgctgaactgctaattcttttgcttctatcttttaggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtgagtatgtgattttcttgtgtgtacatatgtgtctcactttctttttttaatttactaagcagaacttcagatgaggaataaaatgattggaatattttttttctcctctaactacttgtaaatttgggagaatttggagagtgtagtagagtcagatcagtgtatggaaaaggagcaggagtgactggaccttctaagaagtgtgttatcagaattagtaaatgaagggtcaaatgtcctacttttcccctccactgattttgacatcaaaccattatccacatagccttatttcctccctcggtcttaattttattaatattttactgcactttgcagataaaatttttaaaaaatttttaaaaattgccaataagtgacatttattaagttcagtgcttagtgtatatttggattttatttattagtcacaagacctttgtgcaggtagtaggcatgattatctttttttttttgagatggagtcttgctctgtcgcccaggctggagtgcaatggcgcggtctcggctcactgcaacctccgggttcatgccattctcctgcctcagcctcccaaatagctgggactacaggcgcctgccaccacacccggctaatttttttgtatttttagtagagacggggtttcaccatgttcgccaggatggtctcgatctcctgactttgtgatccgcctgcctcggcctcccaaagtgctgggattacaggcatgagccaccgcgcccggactgattatcttatttacacatgagaaaaccagggcttagaaaggttaggtaacttcctctaggttgtacagtaaatgtggacctagaagcattttgacaagagcacctgtttttttttcttctctattagtttagaaattatatactcttaattatcacctgggattttgattagacagccttcatgttctttttcatcttaaatgttctttgtgtcttaaagggctaagtgatttcttcagatcttttagttcactcattctcagtgaactaaaatgaggtctaatctgctactgaatcaagttttcagcatgttatttccttcctccctccctccctccttccttccctcaaccaggctcccgaggagctgggattacaggcgcccgccaccactcctggctaatttttatattttagtagagacggggtttcaccatgttggtcaggctgatcttgaactcctgacctcaagtgacccacctgcctcggcctcccaaagtgctgggattacaggcatgaatcaccacacctgacggcatgttattttcatcgcaaagttactgtaagctgggagaagtggcacacacttgtactcccagctactcaggaagcttaaggtgagaagattgcttgagcccaggagttttgagaccaacctgggcaacacagcaagaccccagctcaaacaaagaaaaaaagttattgaattttttatttctatggatcattttttgtagtttcttattcctttcacccttcattcccacttttgatcccatcttttatttatttagttttattaaatgtatatttgtctgataattctgctatctacagttttttgtggacctgactcagcatttctttgtttcttcggattcagactgttggtggcttgtgattttagtgatttttggccgtgaacatgtttcttggacttttgtctgtgggaattctctgtgtactctgtataaattaagttacttcaggtgttttgcattttcttttgccatgcacctggggcctgggtcactacccttctggtaccacttaaaactgaatttttgtcttgggtgctcgtactgatcctgtatgagtacaggtttatacttactgtagaaatatggtgtttgattatggggtattgtcccagatggtgctggagtattaatatgctctctgttaaacttaatgtgttgtccctgtaaaactccaaaattctgaattccagaatactactggccccaaatgtttaagataagggcactgcctgtatttgtttctgcctcccactattttccttagtttaacacaaactcacctttttaaaaaacattttgagagaattcagtattgggaagagtttctaacctgtttctggaaatggaagtccaaagtctgtttctgtaattgttttttttttgagatggagtctcactctgtcacccaggctggagtgcaatgacgtactctcagctcactgcaacctccacctcccgggttcaagcgattctcttgcctcagccccctgagtagctgggattacaggtgcccaccaccatgcctggctgatttttgtatttttagaagagatggggtttcgccatgttggccaggctggtcttgaactcctgactttgtgatctgcccacctcagcctcccaaagtgctaggattatgtttctgtaattgtaatacatttattgtttttagaaactgtctttgctttagtggtaattttcaataaaaatagaaatagcagtggagttattaaaagagcattagttacatttttccctttttcattatcttcaaatattatatatagtaagtttgacctttttaaaatgtatacttgtatcagttttaacacatacatagattcctgtaactgtcaccactataagggtaaagaacagttagttccttcacctttgaagtcaagccccacctctatcccaacacttggcaaccgctgatctttctccgtctcaatagctttgccttttctctttttttttcttatttttttttttgagacagcgtcttgctctgtcgcccgagctggagtgcagtgaggcaatctcggctcactgcaacctccgcctcctgggttcaagcagttctcctgccttagcctccctagtagctgggattataggcacgcaccaccacacccggctgatttttttgtatttttagtagaaatggggtttcaccatgttggccaggctggtctcaaactcttgacctcaagtgatccacctgcctcggcctcccaaagtgctgggattacaggcgtgagccactgtgcccaatcaggactttttttttttaaatttacattcaacttgtcatttttttcttgtatggattgtgccttcagagtcacacctaagagccctttgcctaagcaaaggtcatgaagattttctcatatgtttccttttaaaagtattgtggttggccaggtgccatggcttatgcctgtaatctcagcactttgagaagctgaggtgggcagattacgaggtcaggagatcgagaccatcctggctaatgcggtgaaaccccatctctactaaaaatacaaaaaaaaaaaaaaattagccgggcgtggtggcgggcacctgtagtcccagctacttgagaggttgaggcaggagaatagtgtgaacccgggaggtggagcttgcagtgagccgagatcgcgccactgcactccagcctgggcaacacagtgagactccatctcaaaaaaaaaaaaaaagtattatggttttacactttacgtttagatatatatcttttttgagttaatgtcgtataagtatgagggttacgtcagattttttgttttttgtttatttttacatatggatgtctagttgttctaataccatttgttgaaaagacaacctttactccattgaattgcctttgtacttttgccatatttgtctaggcctgtttttggactcctttttctgtttcatgatgtgtgtgtctattcctttgttaataccacatggtcttaattactgtatagtaagtcttaaaattgggtaatgctggccttataaaacgaattgggaagtttttatttttactcttatttccattttctagaagagattgtgtagaattggtgtcatttcttctttagatatttggttgaattgggaagtgatgccatctgggcctagggttttgttttttgtgtgtgagacagagtctcacttctgtcacccaggttggagtgcagtggtgagatcttggcttactgcaacctctgcctcccaggttcaagttatcctcctgcctcagcctcccaaatagctgggattacaagcgtgtgccaccatgcccgactaatttttgtatttttaatgcagacagggtttcaccatgttagccaagctggtctcgaacttgtgacctcaagtgattagcccaccttggcctcccaaagtgttaggattatagatgtgagccaccgtgcctggcaggggcctagggttttctttttcagagtattttaaactatgaattcagattatttaatagatataggactatttaagttatctgtttcttcttgagtgaatttttactgtagtttatggcctttgagtaattaattgtattgaattgtcaaatttatgagcgtgtaattatttatagcatttcgggtttgtagtggtatccctcttttattcctggtgttggcaattgtgtcttgtttttctttgtcagattgtatagggatttattagtcttttcaaagaactagcttttgttttgatttttctgttgttttgttttcaattttattgattttctgctctttattatttcttttctattatttctgcttgctttgggtttattttactcttttttttttctccaagttgcttaaagtagaaacttagatttctggtttgagacctttcttttctaagataagcatttaatactgtaaatttccttctaaccactgctttagttacacccccacaaattctggtattttgaactgagcacaaatgaaatgttctaatttcccttgaatcttattcttttaccaatgaattatttagaaatatgttatttagtttgcaagcaattggagacttttttcctgttatttttctaccatttatttctcatttcattatattatggtcagagaatatattttgaatgatttcatttattaatttttaaaaataacattaaaaaattttttaaaatgtgaatataccacatacagtataaagattgtacattctgtttttggacagttttctataaatgtcaagttgatttagttggttaatgatggtgttcagtttttctttattcttgctgatactttgtatgcagttatatcactttattactcagaagagtgttgaactttccaactacaatttttttttccaattttactttcagctctatctggttttgcttcatgtattttgaggctctgttgttaggtgtgtacacattcaggatgatatcttctgggtgaattgcctgttttatcattatgtaattccctctttatggtaattttccttgttctaagatcagaaatatctgttgtccaatttatatagacactgcagctttcatttgattagtgcttgcatggcatatctttttccatttttttacttttgatctacctttataattctatttaaagggggcttcttgtaggcagcatatagttgggtagtgttatttatttatttatttatttatttatttatttatttattgagacagagttttgctcttgttgcccaagctggagtgcagtggtgcaatcctggcttaccacaacctccacctcctgggttgcagtgattctcctgcctcagcctcccaagtagctgggattacaggcacgcgcaccatgcctggctgattttttgtatttttagtagaaacggattttcaccatgttagccaggctcgtcttgaactcctgacctcaggtgatccacctgctttggcctcccaaagtgctgggattacaggcgtgagccactgcacccggctgagtcatgttatttttaatcttttctcacaatacagggtttttgttggtaaatttaattattttaatataaattttagtataattatttacattaaatgtaactgttgcactggggtatttataatgtgtaaatataattattggtattaatataattatattactcataataatattaatatctttggatttagattaccagtttagtatatgtttttctgtttctccctctttgatttccccttttttgctttttttttttttttaattcttatttttttttagtatttgttgatcattcttgggtgtttcttggagagggggatttggcagggtcataggacaatagttgagggaaggtcagcagataaacatgtgaacaaggtctctggttttcctagacagaggaccctgcggccttctgcagtgtttgtgtccctgggtacttgagattagggagtggtgatgactcttaacgagcatgctgccttcaagcatctgtttaacaaagcacatcttgcaccacccttaatccatttaaccctgagtggtaatagcacatgtttcagagagcagggggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaactgccatcgtcatcatggcccgttctcaatgagctgttgggtacacctcccagacggggtggcagctgggcagaggggctcctcacttcccagatggggcagccgggcagaggcgccccccacctcccagacggggcagtggccgggcggaggcgccccccacctccctcccggatggggcggctggccgggcgggggctgaccccccacctccctcccggacggggcggctggccgggcgggggctgaccccccacctccctcccagatggggcggctggccgggcgggggctgccccccacctccctcccggacggggcggctgccgggctgaggggctcctcacttcgcagaccgggcggctgccgggcggaggggctcctcacttctcagacggggcggccgggcagagacgctcctcacctcccagatggggtggcggtcgggcagagacactcctcagttcccagacggggtcgcggccgggcagaggcgctcctcccatcccagacggggcggcggggcagaggtggtccccacatctcagacgatgggctgccgggcagagacactcctcacttcctagacgggatggcagccgggaagaggtgctcctcacttcccagacggggcggccggtcagaggggctcctcacatcccagacgatgggcggctaggcagagacgctcctcacttcccggacggggtggcggccgggcagaggctgcaatctcggcactttgggaggccaaggcaggcggctgggaagtggaggttgtagggagctgagatcacgccactgcactccagcctgggcaacattgagcattgagtgagcgagactccgtctgcaatcctggcacctcgggaggccgaggcaggcagatcactcgcggtcaggagctggagaccagcccggccaacacagcgaaaccccgtctccaccaaaaaatgcaaaaaccagtcaggtgtggcggcgtgcgcctgcaatcccaggcactctgcaggctgaggcaggagaatcaggcagggaggttgcagtgagccgagatggcggcagtacagtccagcctcggctttcacaactttggtggcatcagagggagaccggggagagggagagggagacgagggagagccccttttttgctttcttttggattatttgaatttttccttaaatttatttatcttacttatttatttatttttttgagtgattctcctgccacagctcccaagtagctgggactgcaggcatgtgccactacacccagctaatttttttgtatttttagtagagacagggtttcaccatattggccaggctggtcttgaactcttgacctcaagtgatccacctgcctcggcctcccaaagtgctgggattacaggcgtgagccaccatgccctgcctttttctagaatttatatattgagttcttgattgtatctttttatgtaggctttttagtggcttctctaggaattacaatatacatacttttcacagtgtactcacatttaatattttgtaacttcaagtggaatgtagaaaacttaaccaccataaaaatagaactagggatgaggttaaaaaagagagagaaaagaaatgtaataaagatttaataacaccgtttttttttttttttctcttttttttttgagacagagtctctctttctgttaccaggctggagtgcagtggcgtgatcttggctcactgcaacctccgcctcctgggttcaagtgtttctcctgcctcagcctactgagtagctgggattacaggtgcgcgccaccatgcccagctaatttttgtatttttagtagagacggtttcactgtgttggccaggatggtctcgatttcttgaccttgtgattcgctctcctcagcctcccaaagtgctgggattacaggcgtgagccaccgcgcccggctaagtctttaaatatttttttgacattgcactttttctcttttccttctaggattttagtaacccaaatgttagttttgttattgtttggcaggttcctgaggctttccttacttctttaaatttttttttcctgttgttcagcttcgaaaatttctattcatctgtcttcaaattcactggttctttcccgttatttccattctgttattgagtctttgtagtgaattttaaattttgtttattatgttttttagttctaaaattttctttttttgtgtatgtcttatactttgctcctgaaactcttatttgtttcaggagtgatcttatttcttagagcatggttttagtagctacttaaaatttgttttatcatcccagcatatgtgtcctcttgattgtcttttctcttgtgagataatgggattttctggttctttatatgacaattaattttggattgtatcttggacagtttgacttacgttacatgattctgaatcttgtttaaatcctgtggaaaatattgaagtttttgctttaacaagcagttgacctagttaggttcagtccacaaattctaagcagcattctgtcggctctggttccatcatcagttcagttttgtatcttatctgcttatgtgcctttctgtgtccagtctgggacctggccaatggtcaggtcccaaagcctttgtacacttttagaagcagggccatgcacacccagctcacgagtggccccgggagtgcacatacaactcgacgttttcatgggctccttcttttctgtgatgtccctgacacgttctgccttctaagaacctccctttatccctttcctgttgtctggctagaaagtcagggctttagattccctatacttcagcacacttcctgtagctatgtcaacctctgtggccacgacttcttcttcttgggactgcagtttctcttgtcagaaagtaggattcttggagctgctgtcattgctgctgtggctgctctgatgctgcctgggagtcgaaggagagaaaggaacaaaacaaaacaacccaggggatttcctccactctctttgatccgtgagagccccctttcctgttcctcagaccagaaatagagggcctgtcttggaacttcttctttgtgcatctggtgtgcagtttcagcttttgagtccaggccaggaggtgctggacaaacttgtcaggagtacggaggtactgcaagttctgattacttttctcagtccacctgcttccaagtccttggatgcatttgtccattgttttgagttgcattccatgggagagacagaagagtgtgcttatttcatcttgacatacttattaggatttcatatcaaatcaacggatgatattctctatattaatttgctgttttccctttagcaagcacattaggaaaataacactttaacacccgcctttggtggtttctgtcataattattaatacttgactttttttttttttttgagacggagtctcactctgtcctttgaggcattgtccccataaacttttggtaaagcatcaataattttatctttcatccacacaagcttcaccataaatttgatgtttattcttccattttagcagaattcatgttgctccaataggggctgtcttcaaactgatgttttctccttcttagtgcctcagagtagatcctgttcagatacgttataacaggttaatatgagtttattttggtgtaaaagtactttgaaattcatgcatagttttttcatcatatgcattttccatagctttgaacacccccatgtaactctcctcttccacaaaccaaacaatgaaaaagcacctttgtgatggaagtttattttgcaataggaactcacagtgatctaagccctgctattcatgaatataattcattactggagtccaagttgctttttggtttttgaagttctcttcttcccttgcaggtatagaacaagatgcagtgaatacttttaccaaatatatatctccagatgctgctaaaccaataccaattacagaagcaatgagaaatgacatcataggtaagcagtgcttgaaactatggcaaaaaaaaaatgacaaaaaatgcacagaactgacaattttcgttattgactaagataattttttcttaacatggaatttagcagttcccttcctaatttgttttctgagtattttttatatcggattatagctcactttaaaagtttctcggctgcattcggtgcgagggtctttgcctgggccagatgggctgcagtgtagcgggtgctcaggcctgcccgctgctgagcagccgggccggcgggcggctacgctaaccggcacagaccaccggatggactggccggcagccccgcaccagtgcacgaagtgggcgggacagaaacttctggggttggaagtccagtgaggctaaaagccggtaccaaagtctctaggcatcagggctgcagcccaagagtctcacgaccagtgggcaactggatggccagacaggtgtctcagtggtggcctctccgtctcagggcttcatcccacttctcagtgggcctgacgtccctgggcaccctggatgtctacctgcattagccagagccatcacatggcctgtgacttgcctttttttgccagttgattgtgccacacacagtgtcatttctgtgtcatttggcacagctggaggtgcaaggaggagggcagcctcatgtccagtcccagtttcacgtaactttattcttctgaataaagacaatttgctaaccttaaaaaaaaaaaaaaaaaaaaagtttttcttatatgttggacccaaattcttaggctttaacctgaataacaatgacagcaagatcaataaatagtacacatttattaaacactcactgtgtcccagacaatattccaagcactttttatggatagactcattttaacttctaaagaactttgtgggataaatacagttattttatagatgaagaaactgaagcacagagaagttaagtgctttgtccagggtaacagctcagatatggcagagtcaggatttgaaactagaccctcacataccttaactgctgtgctgtggcagtgtttttcatactgtaggttgggaccagccttctcttatgccctcaccccctgccaaaaaaaaaaaaaaaaaaaaaaaatatatatatatatatatatatatatatatatatatataatatatatatatataaaatatatatatatataaaatatatgtattagtatatatgcatatatagtatatattatatattagtatatatactaatatataatatacatattagtgtgtgtatatatatatatactagaataaaaaaatcaaagtatctcagagtagtaaggacaaacatttcagaaaaatgttttcattatatatacatgtatgtatgtgtatgctgattcaacaaatatatttcttataggttatagcaaaatagtttgaaagcttttactgtgttttatcaggaagaccttaggtgaacgtatattcacagataaaagaggttatttattcattcaataaatattacattctcataagtcctaatattatgtatttttattcttcaaaaaagttagtatttgtgatttatgaaataagacatgttcttgcacttttagcagatctgtcccgatgttgggcttctttaatccttagtgtgggtgctttgcactcactcactgctggggacagcaagacccctgttagtctcagctgtgtttcttaaattggcccactgtaccttccagttagctattctggggtccatgtcatgttggctccattttccttttctttctcccacacagatacctataacggctataacataggcctggtggctgttggtggcttatccctatctgcttgtatttaaggggtactgtttcactgagttttgctgacagatgttgtcatgagatttgaggttttctgtgttgttgctctatttttatgtgggaatttgctactatcatcatccctagaccagcttttcctagtaatacaacagggatgttctgactgattagagtttgcctgtttgaagaattggttggctagtgatttttttttgaggggagtctgtaccagttaatagcctgactggcgtgtggataaaaaggaagcagtttcaagtcaaataaaacacttaaaatgaaaccacactgcaactctctttcttttacttaagcttaatcaaattaatgatgatgtaatcccatgaaggaaaagtcttctgaaggatcaagttgataacattttgtgatcaaagaatttgagaaaacctctatcccagtgtctatcattatatattttaggatgttaattacctgtgtggctttaggcaagtcatttttcctccttgagccccattcttaatcctgtccaaattatttgtctcctcttgcagttggactattttaatatagctgtccttcaagtgagttttgttcaaaggagccttcactttagctcttactgtgtacccactttgcatagtcttgttttaaatgtaatccttggatttttggtgttgctaactaattactgtttttatgtgaggatttagagtgatccagaatctatacttgcactacctccttcatcttccacaaatgtttgaagtggtagaatttttaaaaactttgaaggtacagctgacagaatttgctgatggtttggaagtgagtggtatgagagggaaaaaaaggaataaagcatgactgcattttttgtttgtttgtttgtttgtttttgagacggagtctcactctcgccaggctggagtgcagtggcgtgatcttggctcacggcaacctccgcctcctgggttcaagcgattcccctgcctcagcctcccaagtagctgggactacaggcgctcgccaccacgcctggctaatttttttttttgtattttagtagaaacggggtttcaccgtgttggccaggatggtctccatctcctgacctcatgatctactcaccttggcctcccaaagtgctgaggttacaggcatatatataagcatataaagtgtgttatagcatacaaacaggtatatatataaacatgcagtccacacagctgataggaatgaggcagtagtgaaggagaagttgatgtaggagaggggacagttgttacaggaaagaagtctggaggcagaagggatgaattccagtgctcacatagaagattgcttagatgggagcaaggacaatttatctagagtcacaggaaagaatgcagtacacgggtagagatgcaggtgagttgaaagatgtgagagatgatggaaataattttctgattgcttctatattctcaaggaagcaggaagcaaagtcctcagcaaagagaatagaagaggtgttaaatatttgagaaaggagatgtactgtagaaaaaaaaaaaactcagtttctccttctgaactctcacaaaacagaacccttccatgactctagttgtgtggggttttttccctgtcagctaccaattctgcagatgattgttcagtgaacaccaactgggtgtcctctaagtcagttcagttctcacactgtttacctggagatagcatcagatcccacagattgaggactctgtcccacaagactgcctccacttcagatgccagtctcaagtacaagttgtggcctgtgcttctgactgaccttctataaattggagttcccacagtcccctccttgggttcaataaatttgctagagcagctctcagaactcagggaaatgctttacatatatttacccatttattataaaggatattacaaaggatacagattgaacaggcagatggaagagatgcatgggcaaggtatgggagaggggcacagagcttccatgcactctccaggtcatgccaccctccaagaacctctacagatttagctattcagaagcccccctccccattctgtccttttgggttttttgtggagacttcattatataggcatgattgatcattggctattggtgatcagctcaaccttcagccccctcatcccgggaggttggtgggtagggctgaaagtcccaaacgtgtaattctgccttggtctttctggtgattagccctcatcctaaagctctttagaggccacagccacaagtcatctcattagccttcaaaagaatccagagattccatgaattttaggcgctgtatgctaagaaactggctaaaggccagttgcaatgtctcaggcctgtaatcccagcactttgggaggctgaggcaggaggatcgtttcaggccatgagatcaaaaccagcctggtcaacatagtgagacccccttacaaaaaatttaaaaattggccaggcgtaatagctcttgtctgtagtctcagctactcagaaggctgaggatcactgagccctggagttgaaggcagcagtgagccatgatcgtgccactgactccggcttgggtgacaaagtgagaccttgtctcagaagaaaaaggaaaaaaaaaaaactgggcaaagactaaataacatatttcacagtatcacagatttgtattgtctaggaaagtgaatgtaaacagaccaggacactagtatgatcccttggtttcatgaaggtcccactaaagtcatgaacacaaagtgagactaggcatcatgttatatggtttttccagccatgtttaacagctagctaaatagctaattgtttcgctgcagtttattttagcagttccttattttagcacatttcatgttttaaaatttctaccaataacattttaataaacttttttacagataacttcacaaatccataattttttaagttacaatcccagaaatagaattgctcattgaaagggtatgttcatttttaaagttatgctagaaactgccaaattgccttcagaaaaaggtgtttgtatccccactaacactagtgttagttttcttgtgcccttgctcaagtatacatattattaaaaacaatgttgggccagtttactagataaaaggtgtagtgcctccttattctaatctatttgattactagtgagtatgtatgtcttttcacgttggtcattttatgtttgttcctttgtggattgtcatgtcctttgctcatttttcttttggaacatttcttagtagtttataagagctcttggtattttaatgatagtaaccttttaactgtcatgcatgctgcaaatcttttttctgtttgtttgcctttgtattttgtttttggagggtttctatgtataggaattaaattttatgttgttaaatcttttgatttctgcttttgcatatgtacttcaaaagactttctattttaagatcaagtgttacctgtattttcttttagttctatttaaaacctcttaatttatatgcctgtgctgttaactcccaagttgattcacaagtgtgtatacatagtttgaatttagtggcaatttaattatttacaacttcttttgcagcaaggatttgtggagaagatggacaggtggatcccaactgtttcgttttggcacagtccatagtctttagtgcaatggagcaagagtaagttagttcatattttcacattgtgcatcctagggaatttgggttcattgttaggaatgggcttcactcagctaaaaacaaagtatttttgagaatttaaatattttggatatttacaagatcatataaagcatactctatcttggttaacagtttcttttaaatataaattatgtgaactcttaaaattttcattttcattttcaatgttaatatttcctaagttaaaataatttgtttttagttctgaaataatttggggagtgattgagtctgtagtgattatgactattagaattggtttatttatttaaataatgcatgtcttcagatggctctcctaatttgttagttaggctttaagctaaatggatgctatataactaaatccacatagatttgttgaaatggctccagaggttttttagatttattactgctatgtgcccttaaaaaaaatctattcattctttcacttaacatttatcagaagagtgctctgtgtaagacgtggttaggcatagtgccagtcttgaaggaagttacagcctaataaaagacatagggcatgttgtttggttactgtaatatgaagtggcatgtgttaaatgtcaggggagaactacaaagtcataaaaaggtgggagagattacatacaggtaaaggaatcaggaatgacaccatggggagtaaggtagtgttgacctaggcctttaagatacaatagggacagtatggaaagagtatatttttcccacttaaactctttccttggtcgttccctcaaattttcccttttgtccatgtgcaggcactttagtgagtttctgcgaagtcaccatttctgtaaataccagattgaagtgctgaccagtggaactgtttacctggctgacattctcttctgtgagtcagccctcttttatttctctgaggtaaagtctgcatttcttttcacactctattcgagcattccagcctctaactatcaatgctggggccctgtctataggaaataacacagaagagccaagtcatttccaaaaagatgtatcattgtttcaagttgtttctgatggcaagagtaatttaataatatattagagagaacatgaaaattcaatgtattaaataactctaattttgagaaacctaattaaactactgcatgtaagagagtgcatgtttttaattatttggagctattttaaaaccacagaatttgaaacttgcttccagtgcataaattgcagaccagacttcagaagagaaaaaaagtagtaaattttttcttatgctcatcatttttactttagtcacttgataggattgcccagtgaagaagcatttgcaacagacaatgagtatattaatctttttgaggcatacagtttagtataatgctctttgttaggcttcaacaagtgaaattattttgttggaaagcaaatgactattaagtagaaagaggattcccagtctcacaaagcagtaatttagacactcgattctgcctctttacaagaatacaggtactcagttgatttgttttctcactccctttctttgctataagtttaaatcaacaatttgtttaggttaatatgtcctcatggaatggtggaaatgatcagatataaaatatttggtttggttagtttactctttatatgtttgctggcaaggaaccacaaatccagtttagtataatttttactctagttcactaaaagtttgcatccagctgtgtaggtagtgtttgtttcttgttaacttttttttcgtctaaaagaatactttaaaacttttcaatctcaaatgactgtaacttgctgacaggtgttaacagaagaagtagatctttttgttttttgcttatgacctgtattttaatatttgagcttatagattagagattgtgagagaaatctgtttatagtcttattttcccttgtgtattttttcttcctagtacatggaaaaagaggatgcagtgaatatcttacaattctggttggcagcagataacttccagtctcagcttgctgccaaaaagggccaatatgatggacaggaggcacagaatgatgccatgattttatatgacaagtgagttatattgatagatggattcagcagatacttattgaacatttgatatgttttgtggaaataaagatgaataaactcagtctctgttgtcaaggagctcacaggaggcagcataaaagctgcttttatatggtgtttgtaaagctttgggggttcttagaacaaaagtttctgctgggaaaggggaggtgtatgtggggtaaacaggatggcaatggtggtgttcaaggagtgtttcccagaagagagattttgtttggatcccaaagaaagaagggaattttgctacccagagaaggcagaaaacaacattctaggcaaaggcattggcccagaagccatggaaacgtaggggaaagtggcactttcaagaaacttgagtttagataatcaaaggagtggggaataaatatgaggatgctggtactaattggaatagattgtaagggaccttgaatgcctatttatgggtatattatactttctgtataaatctgctcaggcacgttgttaattagttttttattagttttcactgaaaatgagaggatggaaacatcatacagtaaacaaaattgaaaatatctggtcaggcagatgatgagcttgtggccagctctgtaacgtatggtattcttttcatttaacttttcttactctgtaaaaaaagtaattcgtggtcgggcacggtggctcactcctgtaatcacaacactttgagaggcagaggcaggtgaatcgcttgagcccaggaatttgagaccagcctgggcaacatggcaaaacccgcctttactaaaaatacaaaaattagctgagcgtgatggcgtgcgcctgttgtcctagctacttaggggcctgaggcagaaggatcacctgagccttgggaggtcgaggctgcagtgagctgtgatccactgtactccaccctgggcagggcagtagagtgagaccctgtctccaaaaaaaaaaaaaacaacaaaggtaatttgttatttgtatccttaagcaaatgctaaaggggtaacttggggatagagaaaagtccacagatgttagggtttgaagacactaatagtatctaggccagtggttcctgaacattagtctgtgggctcttgctgggctgtctgcataggaatcacctgagagcttattaaaaataggttttcaggctggttgcggtggctcacgcctataatcccagcactttgggaggctgaggcaggcggattacttgaggtcaggcgttcaagaccagcctggccaacatggtaaaaccccgtctctactaaaaatacaagaattagccaggcatgatggcacacacctgtaatcccagctactcaggaggctgaggaaggagaattgctcgagcccgggaggtggaggttgcagtgagcggagatcatgccactgcactccaggctggctgacagagggagactctgtctcagaaaaaaaaaaaaaaataggttttcagtctgggtaccggtggctcacacctgtaatcccagcactttgggaggccaaggcaggcagatcacttgaggtcaggagtttgagaactgcctggccaacatagtgaaaccttgtctctactagaaactacaaaaaattaactgggcattttgacgggtgcctataatcccagctactagggaggctgaggcaggagaattgcttgaacccgggaggcagaggactgcatctcaaaaaaaaaaaaaaaaaaaaggtttccagtccccctgtctcagaaattctgattctgcaggtttgaggtgtgaccaggaatctttatttttagaagacataccagataattctgataaatagccagtttagggatgtagtctaattttcctattttgcaagtaaggaaaataaggcccagagaggtaatgattttctcaaagtcacagaacaagttagtggcagaatttggactggaatgcagttcttaatgttctgtccagtgtttattctggtacagtatgtttgtagaaggtattacgtaagaaacattgttatatagatgttgagataggaagagtttacatttagaaatttggtctaaaatgcctgaacattcaagtcgtggaggagtattgaccaacttactcaatacaacataggagattcacattttgttacaaaaatgctgatttaaaaggagagttttcttttttttcttcttttttattttttgagatggagtcttgctctgtcacccaggctagagtgcagtgacacgatctcagctcactgcaacctccacctcctgggttcaagcggttctcctgcctcagcctcctgagtagctgggattacaggtgggggccaccacgcccagctaatttttgtatttttagtagagacagggtttcaccatgttggccaggccggtcttgaactcctgacctcaagtgatccacccaccactgcctcccaaagtgctgggattataggcgtgagccactgtgcccagcctgcttgtttttgtatcatatatatgcatcatcataatcatgcattatcaacctttgtatttctgtcaggacatagaaaccattagagtgcttggaagagagcctttttttttttctcgcatttaatgctttttttggtattcatttcataatcagcttaccaaaacattacctgcattataccccatcaaggtagaaatctttgtgttatcaatattggttactccctttccacaccgagtcatcagtaagtcctgttctatccaaataggtcatatgcatctagctcacccctcagtgctgttttgttttgaatttgtacatgtttactcctgatgccttgtagttatgatgatgtgttcttattttattctgtgcatacaagttctcagctcgctttttagggaaaatgaccatgtcttcctttcctataaattcctttctatctatcaagtcctcaacagagaataggtacccataaatatgtgattgttagtttctttgcctcagttgtagtctgatccttacagcttttaaacaacagtagagttcaccgtcaagaactaaggatggttggcaggcagatagaaaggtagcaagttgacccaactatctctggggaagtgggaacaaagaaaggttacatcagcactgtcatcacatagctctatagttctaggcctgcaggctcaatcaagtagccttgtataagattctctggaggaggtgctgaaagttgcttatacttgctatggaatttgattttacttcggatatctttttaccataggtacttctccctccaagccacacatcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagtaaaaaagaaaaaagaaaaactaaaaagataaaagaataaccaagaacaaaacaaaaaaaattataatggagctgaaaaatctctgttgcctcatatttactgtactatacttttaatcattattttagagtgctccttctacttactaagaaaacagttaactgtaaaacagcttcagacaggtccttcaggaggtttccagaaggaggcattgttatcaaaggagatgacggctccatgcgtgttactgcccctgaagaccttccagtgggacaagatgtggaggtgaaagaaagtgttattgatgatcctgaccctgtgtaggcttaggctaatgtgggtgtttgtcttagtttttaacaaacaaatttaaaaagaaaaaaaaaattaaaaatagaaaaaagcttataaaataaggatataatgaaaatatttttgtacagctgtatatgtttgtgttttaagctgttatgacaacagagtcaaaaagctaaaaaaagtaaaacagttaaaaagttacagtaagctaatttattattaaagaaaaaaattttaaataaatttagtgtagcctaagtgtacagtgtaagtctacagtagtgtacaataatgtgctaggccttcacattcacttaccactcactcgctgactcacccagagcaacttccagtcttgcaagctccattcatggtaagtgccctatacagatgtaccattttttatcttttatactgtatttttactgtgccttttctgtatttgtgtttaaatacacaaattcttaccattgcaatagtggcctacgatattcattatagtaacatgtgatacaggtttgtagcccaaaagcaataggttgtaccatatagccaaggggtgtagtaggccataccatctaggtttgtataagtacactctgtgatgttagcacaatggcaagcagcctaacggaaattctgtttattgattgattgattgattgattgattgagacagagtttcactccattgtccaggctggagtgcagttgcacagtcttggcacactgcaacttctgcctcccaggttcaaccaattatcctgcctcatcctcccaagtagctgggattacaggcaggcaccaccatacctggctaatttttgtattttagtagagacagggtttcaccattttggccaggctgttctcgaactcctgaccttaagtgatctgcctgctttggcctccgaaagtgctgggattacaggcatgagctaccatgcctgggcagtaactgaaattctctaatgccattttccttatctgtaaagtgacgataatatgcacgtttacctcaaagttactttgatgattaaagtaaggtaatgtatataaaatacatattaacatagtacctgacacatggtaagcatcaaaaaatgttaactacttttattactattattattacgtatttttaaataattagagagcagtatcaaaaattagctgggcgtagtggcatgcacctatagttccagctactcaggaggctgaagctggaggattgcatgagcctgggaattaaaggctgcagtgagccgtgttcatgcccctgcactccagccttggtgacagagcaagaccctgtcttgaacaattaaagaaggcattatgccgcaacgttagcttagaaatgatccacatatatcaccagtaactgtcaacaggattggaaccctagttttgggtattatgatcacaaggtattattaatagcttattaataataaagcgttggctaggcacggcgactcacatctgtaatcccagcactttgggaggccgaggtgggtggatcacctgaggtcaggagtttgagaccagcctgaccaacatggagaaaccccatctctactaaaaatacaaaattagccgggcgtggtggtgcatgcctgtaatcccagctacttaggaggctgaggcaggaaaatctcttgaacccgggaggcagaggttgcagtgagctgagatcgcaccattgcactccagcctgggcaacaagagcaaaactccgtctcaaaaatataattataataaataaataaaagtaaagtattgatgtttgtgaatgatttattcttctaatgaactagaggagatttttccaggaatttcagagccagtgaggttatgttgcttgtatgtgtcatgtgtatccaggtgaaaaaacttaattaaacgctattatataataccatacataaaaactgaattttaggaatactgaagaatgacatatagaagtcaaatcattaaatagctagtagtaaacagaatagagtgtcagctgttacccaatgatgataatattttcacgattaaaattaaaccttttctgattttaaaggaaaagttcagatctgtatcatataaagaatgtaaattttcagggtaataaaattaaaatgcagagagaaaaatgcaaaaatagttcttactagatgtgtgtatgtaaggaacttagactaattttaagaacactgtcaagaccctggtagttaggtaggaaaaaagacatgaatgattcattcaacaaaaactttgagtatttctgtgctagatggtagtgttacagtggtaaacaaaataaatgtgtttctgctatcctggagcttagtctacaaaaaaggtacatattggccgggcacggtggctcacgcctgtaatcctagcactttggaagatcgaggcgggtggatcacctgaggtcaggagttcaagaccagcttggccaacatggcgaaaccccgtctctactaaaaatacaaaaattaactgggtgtggtggcggacacctgtaatcccagctactcgggaggctgaggcaggagaatcacttgaacctgggagacagaggttccagtgagtcgagatcatgccactgcattccagcccgggggacaaaagcgaaaatacgtctcaaaaaaacaaaaacaaacaacaaaggcacgtattaaatacgaacataaatatttacaaattatactgaataagttctcatgtttattatttgcttgtccagttacaaacttttccttcgtagaattagaaatataaataataaacatgagaactcattcagtataattaataattattaaatgtaaataaaaacatctatgtacaattaggcatttatttaagaattatttgaaaaaaaaacaatgtggaaacagatattttgatatattgctagtgattgaaattgataatgttcttttgaagagtaaagtgaccatatatattaaagttaaaatttaactcagcaatcacacgcctggtgagttatcttaaggaaatcagtttgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttttttttttttagacagtcttgctccagcgtccaggctggagtgcagtggtgcaatctcggctcactgcaacctccatctcccaggttcaagcaattctcctgcctcaggcctcccgagtagctgggattacaggcgctcaccaccatgcctagctaatttttatagtttttagtagagatggggtttcatcatgttggccaggctggtcttgaactcctggtctcaagtgatccgtctgcctcggcctcctagagtgctgagattacaggtgtaagccactgcacccagccttatgcattataattttaatttgtaaactgtacaaagggataatacttgtagtacaacaagaagtaaaaacatttgttataggtagttaacatttgtaaccagtagaattataggtaaaatttatttatttaaaacagttttagttggatttgatttcaactttaaaataatgcttttcatctctatcaggtctttttgcctggctttttgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcaggtattgactgattgcgtctgccattagggagaaaagcatacacatcctttccttcacatcccagtaacagatcctattatttgtaaattttaagttgtggaaaaaaaagataaaagccaggcacagtggcctgtgcctgtaatcccagcactttgggaggctgcggtgggcggatcacacgaggtcaggaattcgagaccagcctggccgacatggtgaaaccccatctctactaaaaatacaaaaattagccgggcatggtggcaggcacctgtaatcctagctacttgggaggctgaggcaggagaatcgcttgaacccaggaggcagaggttgcaatgaaccaaaatcacgccactgcactccagcctgggtgacaaagtgagactgtgtctcaaaaaaaaaaaaaaaagagagaaataaaattagcctacttactatcttctaatcaaagcatttgtggtaacttaaaatatactgtattgtaaagtatcatgctgtttcatttaggccattattctatttgaatctgtggctgtttctcttaataaatcaagtaatatggaatatattcatagcctctgaagagctctttatgtaagtatttatttaggatactttttgtaaaataagtgaatgaattcttaggtctcctttttttttcttttcttgagacagggtctcctcgctgcaacctggaaattctgggctcaaataatccacccaccacagcctcctgaatagctgggactagaggcatgcaccaccacgcctggctaatttgaaatttttttttggccaggcatgatggttcacgcctgtaatcccagcactttgggagaccgaggcaggcagatcacgaggtcgggagatggagaccagcctggccaacgtggtgaaaccccgtctctactaaaaatacaaaaattagctggttatggtggctcatgcctgtaatcccagctacttgggaggctgaggcaggagaatggcttcaaccagggagtcggaggttgcagtgagccgagatcacgccactgcactcctgcatggtgacagagtgagactccatctcaaaaaaaattttttttttaaatgatggagtcttgctgtgttgctcaggctggtcttgaacccctgacctcaaatgccgcctgcttcagcctaagtttcttttttttttgtaaagagacagggtcttgctatgttggccagggtagtctcaaactcctggcttcaagcagtcctcccaccttggcctctcaaagtgctgggattacaggcgtgaaccactacctataatgttgtgtttcactcaaggccttttgatttcgttttgcattaccgtgccacattgtgcatttccttgaccttttttgggttttttggagtgctttcatatgttaaaccatacctgattctcctcaaaatcacacaaagtagaatatcctaagacaagaaatctaaggaggcataaagaagttaactggttttattaaactcacacagtaaatgatagagccagaaatattccccttctagtgttcttcaccatcagcttaatgtagcataataattttctaattactgttgacaaataaataaccctttgaattttcaatactgggccttggataaattttcctaatttgtaagagagtattatcgtattgccatttacaaagctctcctgagtatctttttcttctgttaagtttacctaggagataaactgctgagtatggttgccattttggttttttgatataggttagaatgtcttggttttttttttttttttttttggtttttgttgttgtcattgtttgagacagcatcttgctctgtcgcccaggctggagtgcaatggcacgatcgtggctcactgcaacctccacctcccgggttcaagcaattctcctgcctcagcttcctgagtagctgggattacaggcatgtgcaaccacacctggctaatttttgtgtttttagtagagaaggggtttcaccatgttggtcaggctggtattgaactgctgacctcatgatccacctgcctcggcctcccaaagtgctgggattgcaggcatgagccactgcacctggctgaatgtcttgtttttgattaggcacttaagaaaggcctaggtactaaccataaaatatatttttataccttttgttgatactatatatatagaaaactgcacttatcataaccttagacaccttgaagaatgttcacaagcagaactaacccatgtgacccagcatccagatcaaaaacagcattatcagcccctctagaagccctcttgggccccttccattcactgtccttcttgtcaccagggtagctactatcctgacttttgatggcatagattagcattacctgttcttgtcattttataaataaaaccatactgtgtattcttttcttgtacagctttattgtgctaattcacatttacatcatacaattcagtggtttttatatggtcacagagttaggtaaccattaccacatcgattttagaacatttttttcactccagatagaaaccccctttacttaaactccaaatcccccactccaccagccctaggcagccactagtctactttttatctctatagagacaatagatttgcttattctggacatttcataaacatggaaccgtatattatgtggtcttttgttgccaactgtctttcacttagcatcatgtgttcaaaagagcatcatgttatccatgtttggcatgtatcagaattttattcctcattatggccaaatatcccattgcaaggatttatgacattttatttgaattgtaccctcctttctgccatttatcaataatgctactgtgaccatttgtgtacaagtttttgtgtggatacaggttttctttttgtttttaaatttgaggtggagtcttgctctgtcgcccaggctggagtgcagtggcacaatctcggctcactgcaacctctgtctcctgggttcaagcagttctcctgcctcagcctcccgagtatctgggactataggcacgcaccaccacgcccagctaattttttagtagagatggggtttcaccatgttggccagtctggtctcgaactcttgacctcaagtgatccacccatctcggcctcccaaagtgctgggattacaggggtgagccactatgcccggctgtggttttcatttcttttgttgtatatacataggagtagaattgctgagtcaagaggtaactcttaaacttattgaaaaactgccagattgttttccgaaaaggctgcaccattttgcaatcccaccagcagtgtatgagttttacagcttctccacatttcattggaacttattatctgtttggctgtttttaaaaatgatagtcattccaataagttctacttcagtgtggtttttgcacttctctgatgagtaatgatgttgagcatcttttcatttgcttattggcctttgttctagctttggaaaaatgtttattcaaatcctttggccatttttatttttatttttatttatttatttttttttgagaccaagtctcactctgtcagccaggctggagtacaatggtgtggtctcagctcactgcaacctccgcctcctgtgttcaagtgattctcctgcctcagcctcccgagtagctgggattacatttcaggcacctgccagcatgccgggctgatttttgtatttttactagtgacagggtttcaccatgttagccaggctggtcacaaactcctgacctcaggtgatctgcctgcctaggcttcccaaagtgctgggattacaggcgtgagccattgggcccagcctagattttcttttttctttttttttttgagaaggagtcttgctcttgttgcccaggctggagtgcaatggcacaatcttggctcactgcaacctctgcctcctgggttcaagcgattttcctgcctcagcctccccagtagctgggattacaggtgcctaccaccacacccagctaacttttgtattttttttagagacagggtttcaccatgttggccaggctggtctcaactcctgacctcaggtgatccacctgccttggcctcccgaagtgctgggattaccggcatgagctaccaggcccagccaattttctcattatattgcccaggctggtctcaaactcctgggttcaagtgatcctcctgccttggcctcccaaagtgtggggagtacaggcgtgagccaccttgctcagcccctttgcccatttttaaattagattgcctttttatattgagtttcaggagtcctttatatattctagataaatgtcccttatcaaattatattatttccaggtattttcttcattctgtgagttgtctttcctctaccttttaaaaaaggtgggtttttgtttgtttgtttgtttgtttttttaagataaggtctcattctgctgcccaggctggagtgcagtggcacaatcacagctcactgccacctcaacttcctgggccgaagtgatcctcttacttcagcctcctgaatagctagggccatagatacacactatcacacccagctttttttttctgtttgtagagacagatcttactgtgttgcccaagttggtctcaaactctaggctcaaagtgattctcccacctctgcctcccagagtgctgggattacaggtgtgagccacacgcaacctgtcttttcactattaatagtgtcttcctgcttcagcctcccgagtagctgggattacaggcacccaccaccatgcctggctaatttttttgcatttttagtagagacagtgtttcaccatgttcacccggctggtcttgaactcctgacctcaggtgattcacctgccatggcctcccaaagtgctgggattacaggcgtgagccactgcacccggccaaaatattgccttcttaacagtattgtcttctaatttgtgaacatggatgtatcttcatgtatttatgtgttctttcatttcagcagaattttgtagttttcagagtagaagcctttcacctccttgggtcatttattcctatgttttaagttcttttcgattccattataaatagaattgttttcttaatttcattttcagattgtttgatgagagagcatagaaatacaagtgatttttacatgttgatcttgcaacttcaactttgataaatctgattgttagctctaatagttttcttgtggattctttaggattttcaatatataagatcatgtcatttatggatagagatagttttttttctggctagaacttacagagcaatgatgagtagaagtggcagaagcaaaaatctttgtcttgtttcctatctgacagggaaagctttcagtttcatcatttaatatgatgttaggtgtgggttttcaataaatgccttttttcagattcaggaatttccctatcattcctgattttttaaggcttttttttttttttaaatcatgaaagggtgttgaatattgtcatgttctttctgtatcagtataaatgatcctatggattttgggttttattctgttgatgtgaaatattaattgattttcagatgttaaaccaaccttgcatacctgagatgaatctcacttggtcatggtgtataatcttttcaatatgctgctggattccatttactggtattttgttgaagattttgtatctgaacgcttaagataacatttacactctatcagaaatgaattgaccataaatgtgagagtgtatttgtgggttcttgattctcttccattccaaagatagacatacatccgtctgtatgtctgtctttatgccagtaccatactctcttgattactattgctttgtaataagttttgaaatcagaaagtataaatgagattttggtatctgagtaacagtcctcatagaattagttgggaaatattccctctttattctggtccctctttcttttttgtttaactgtgtatcttggagattgttccttctcaacacatgagagccgctttccctaccctcccacccctgctatagagaggtctataagtgtctgttcaattattttatttacttaacctattacttagtcggggacattaagcttgtttatgtcttttattttaaacaatgctgcagtgaataatcttgtatataagtcattttccatcaatataagtctctctgtaactgaatttttagaagtggaatttctaggtcaacctatggctctgtatttcacaaaaataccaattctggtttttcttgtggaggtggggagtaggaggtagaatgctggaggagaacttgctgtactcagctggctagtcattttagaaaggtttccttagcttctttttgtcatatggcctcaccaagaatcaaaaacattcctatttaccctgtaaacatggggctttactacccaagatacatatttctggatgtatgacagcttttcatattgaagaaataatgctgtgagtacagcacatttgttggaacttaggtcgttaagaatgtcttataaattcatacattatacattttattttattttattttttagtttttgatacagagtcttcctctgtcgcccaggccagcgtgcagtggtacaatcttggctcactgcgacctccatctcctgggctcaagtgattctcatgtctcagcctccagagtagctatggttacaggcatgcaccaccatgcccggctaatttttttatttttagtagaaactgggtttcaccatattgaccatgctggcctcgaactcttggcctcaagtgatcggcctgcctcagcctcccaaagtgctgggatccttgtattgggtaaaagatgaatattgagggctgcatggtggctcatacctgtaatcccagcactttctgagactgaggtgggaggagtcctggagcccaggagggtgaggctgcagtgagttgtgatcgcgccattgcacttcaacctaggaattataggcttcagtcactgtgcccggcatgtacattttaatattgtgctttcctcttttagctatagtatgaggttacatttcagagtcattgttgttaagcatcttaatagtgatgaggttgagtgaaagttacttctatttcaaacactgaagaaaattttgtacaaatctgtcacattccaagcccaggactgattgtttcatatacttctaattttacaatttctattgtagtccagtgtgaaaaaagccagtattaaaatactgaaaaattttgatgaagcgataattgtggatgcggcaagtctggatccagaatctttatatcaacggacatatgccgggtaagcttagctcatgcctagaatttttacaagtgtaaataactttgcatcttttaaattttttaattaaattttacatttttttctaatctattattatatgcccagaactttcacttagagtgtgcagtataatgtggtggttaagtataaaggctctggagtgacttcctgggttttaatcttggctctgccatttattggcagccgctaacctcttggtatctcagtttcttcatctgtaaaatgagaataataaagtgaaaagatgccaacatcatttactctgggctgcataactgatacttggaaaaagtattcctttgagtttaagaattaagttggttattcattttagcttgtaataaaaagatagtgattcataggatatgccacttactgaaatttaccacagatccaatcataaaatcactttctcttccctaaagatagcttgattaacatgtaaaggtgtgtaaaggcttgattacactaccctgatccgtaccccagttcccagcagcaccatgaaaaagggatttcaacatatttaattactttcagtagaaagtaacagtggtaggccaggcgcagtggctcacacctgtaatcccagcactttgggaggccgaggtgggcggatcacgaggtcaggagattgagaccatcctggctaacacgatgaaaccccgtctctactaaaaatacaaaaaattagccgggcatggtggcaggcacctgtagtcccagctacttgggaggctgagacaggagaatggcgtgagcccgggaggcggagcttgcagtgagcttagattgtgccactgcactccagcctgcgcagtggagcgagactcttgtctcaaaaaaaaagaaagtaacagtggtattgggagactgaggagcctagaaagtacttgaaggaagtaaaaggtttgtttgaccacattgtatttggaaagccagctttttcagctgtgtcagctttgtgtagtgatttttagttcttcttttagaaaataacggacaaggccgggcacggtggctcacgcctgtaatcccaccactttgggaggccgagacgggcggattacctgatctcaggagttcgagaccagcctgggcaacatggtgaaaccccgtctctactaaaatacaaaaagttagccgggcgtggtggcgtgtgcctgtagtcccagctactccggaggctgaggcaggagaattgcttgaacccgggaggcggaggttgcagtgagccaagatcacaccattgcactgcagcctgcgcgacagagtaagactctgtctcaaaaaataataataaaataaaaaagaatggacagtaaacctaaatgagttcattcccaaagatgatgttattcttaagggatggttcatttatttaagaccttacataaagtctatcaattgcgtgatttttcacttctgtaattgtgtgtatgtataatgtaaatatatatgtttttgttttgttttggttttttgagacggagtctcgctctgttgctcaggctggaatgcagtggtgcaatctcagctctctgcaacctctgtctcccaggttcaagcgtttcttctgcctcatcctcccaagtagctgggactacaggcacgtgccaccacgcccggctaattttttgtatttttagtagagatggggtttcaccgtgttagccaggatggtctcaatctcctgacctcgtgatccacccgccttggcttcccaaagtgttgctattacaggcatgagccaccacacccagcatgtattttttaaatgtataaaatgaagcagaaaagagaaatgataatttttcttcatcttgaaagattatcttcaccaggcgcagtggctcacacttgtaatcccagcactttgggaggcctcggcaggcggctcacttgagttcgaaaccagcctggccgacatggtgaaactccgtctctactaaaaataaataaataaagatggttttaatatatgttttagttttatgattttagcatctttctgaaatttttctcaaggcaagtaaatttgtatcagttggtatattggtacccatctatgaaataacttattaggaagatatctctaaaataagatcactttgcctaaaataaactgatatattgatgttcacagaatttttcttttaaccgacttgataaatgcattattcttgacgtcaagtgatccaccttcctcagcctcccaaagtgctgggattacacacatgagccaccgcacctggcattattcttataaaaggttaaatttctagttaagtttaatgtcctctttgttcatgtaccattgcttattttcttcccttcctactcacagtaatcattcttatggtatgcacttttgtttgcttatttttatgtaattgatattacgctccattctgtacgttgtactttcattcacagtgagttttggacattcctatgttcatctatacagacttacttcattttaactacactgtagtattccgtatgtaatatttactataactcatcactgtagcagagcatctcatagtgtatgtattactgttttgccattttggtatcaatgagtatttaagtcatttgcagtttttccctcttatacccagtattacagaggatctctttttatatgcttctttgtaccaagaggcagattaaaaaatttttttttgaaaaaatttttgaaaaaaaatgaaatgaagtctcactatgttgcccaggctggtctcaaactcctaggctcaagcaatccttccatcttggcctcccaaagtgctggggttacaggcatgagccaccatgcctggcctacattttaaattttgatagctcttacaatttactttgtaaagtatctgcatcattttatgttctcaccagtctttaataagaatacttcatacttttggctggacacagtggctcacgcctgtaatcccagcactttgggaggccgaggcgggcagatcaagagatcgagaccaccctggccaatatggtgaaaccctgtctctactaaaaatacaaaaattagctgggcgtggtggcgcacccgtagtcccagctactcgagaggctgagacaggagaatcacttgaacccgggaggtggaggttgcagtgaacttagatcacaccactgcactccagcctagcaacagagtgagactctgtctcaaaaaaaaaaaagaatacttcagacttaattttttttccagtcttaagtgtttgctaatgagattgagtttcttttggtatgtctcttgattgttcaggttttttcttttatgaattgactgttcatctctttttcacattatttctgttgggtgattttattagtgacttgttaaaattctgtatattttttcagcatgacacttcattattcaaaaaaaaaaaaagattctctatgtttctcgatactaatcattggttggtaataccttaaaaataagacccttactgtattttttgcttttttttttttttttttttttttttttttgagatagagtcttgctctgttgcccaggctggagtgcaatggtatgatctcggctctcagctcactgcaactgcaacctctacctccctgtttcaagcaattctcctgccttagcctcccaagtagctgggattacaggcatccaccaccacacccagctaatttttgtatttttagtagagacagggtttcaccatgttggccaggctggtctcaaactactggcctcaagtgatccgcctgcctcggcatcccaaagtactgggattacaggcatgagccacagtgcctagccactttttgctttttaactttgttttatagtactatagttttagtataaacagatgtatgtatacacacaactatggctttataatatgtttcagtcattgttagagcaaggcctaccttttgggtgcttcttttacaaaattgtcttggctattcttgtgccttttttcttatttgtgaattttagaattgtgaattacctgttgactcaccatgttttgtaaactgaggattttgaatggaattgcactcaattaaagattatcttgctttctgtgcagcaatgttttatttcaaataatccctactttaaattacttaggatagctataaattgtgtttctggctttctagatttagatgaaacgctttaaattgattgttttctcctaaatttaaaactgattgttagaagttaaagtcttctgttcattcttatttaggaagatgacatttggaagagtcagtgacttggggcaattcatccgagaatctgagcctgaacctgatgtaaggaaatcaaaaggtttgtggtgtttttatacttcatattaagcctttactcacattagtgattgactgtaagtcaaagaccacttaaggtttaaactgtttattttgtaaagtaaccactgtatctttcaccttgtgtttatagtcagaagtaagtacaagggcttcctgtagtcacatctttatgcaatctcctctgaatcaaaagttagtgaacttgctttgccactccagaaggcacatgaatatgaaaaagcattgtctattttcttatttaatggcaaaatacccgacctaagttggacttaatgtttgagaccgtttattttattaaattatattttttctcttttcttttttttttttgagacagttcttgctctgtcacccagaccggagtgcagtggtctgaccgcacctcactgcaacctctgcttcctaggttcaagcgattttcctgcctcatcctcctgagtagctgggactacaagtgcgcaccaccacacctggctaatttttgtatttttagcagagatgaggtttcaccacgttggctaggctggtctcatactcctgacctcaagcaatccatccgccttggcttcccaaagtgctgggattacaagtgtgagccaccatgcctggccttattaaattatttttattaaatttcctcaagattgatgaaagtaatgaaatataaaagtaatgaaatatatgtggaaaatagactggattaagaaaatgtggcacatatacaccatggatactatgcagccataaaaaaggatgagttcatgtcctttgtagggacatggatgaagctggaaaccatcattctgagcaaactgtctcaaggatagaaaaccaaacaccgcatgctctcactcataggtgggaattgaacaatgagaacacttggacacagggtggggaacatcacacgctggggcctgtcgtggggtggggggctgggggaggaatagcattaggagatatacctaatataaatgacgagttaatgggtgcagcacaccaacatggtacatgtatacatatgtaacaaagctgcacgttgtgcacatgtaccctagaacttaaagtataataaatttaaaaaaaataaatatatgtggaaaatattaataggtcaaaattcaaattgttcatttaatcagaagagtagtttagtcaaatccaagggttagacaacagaaatcttttttgtcaagtgcattctttgtgactgatttcattttcttcctggtttacacaggaagatttcagaaacaaatgtggatccgtgacagatggtatctagaagtttttagtttggttgaattgacagtattttattgagtaaaagatactaatttttgtaagaagaaaaattcaattttgataagtatgtttaagattaagagctattggccaggcgctgtggctcatgcctgtaatcctagcactttgggaagctggagcaggtgggtcacgaggtcaagagattgagaccatcctggccaacatggtgaaaccctgtctctactaaattagccaggcgtggtggcacatgcctgtgcacccgcctccgggtttaagcgatcctactgcctcaggctcctgagtagctgggattacaggcgccatggctaatttttgcatttttagtagagacagggtttcactacattggccaggctggtctggtctcaaactcctgacctcaggtgatctgcccgccttagcctcccaaagtgctgggattacaggcatgattcaccatgtctggccatttatcttattttcttttttttttttttttttgtttgagacggagtcttgctgtgtcgcccagagctggagtgcaatggtgcgatctcagctcactgcaacctctgcctcctgggttcaagcaattctcctgcctcagtcttccaagtagctgggattacaggcgcgtgccaccacatctagctaatttttgtatttttagtagagacagggtttcaccatgttggccaggctggtctcggaactcctgacctcgtaatctgcccacctcggcctcccaaagtgctgagattacaagtgtgagccactgtgcccagccatcttattttctttctttttttttgtcgggtgggagggggacagagtctagctctgtcgccaggcttggctcactgcaacctctgccccccaggttctagcaattattctgcctcagcctcccaagtagctgggattataggcacctgccaccacgcctggctaattttttgttatttttagtagagatggggttttgctatgttgaccatgctggcctcaagtgatccgcccaccttggcctcccaaagtactgggcttacaggcgtgagcttgtattgggtaaaagaacaatattgggggctgcatggtggttcatacctgtaatctgagcactttgtgagactgagatggaaggagtgttggagcccaggagggtgaggctgcggctgcagtgaattgtgatcacgccattgcacttccacctaggtaatggagcaagaccatgtctctaaaaaacaaaacacaatttttttaaggaatactgggaagaggtcagtggtggttttagaacagaggaagtgccagatgacctttgtgaggcattggccaggaagaactctacagtgtctttaggtagcttctgtccataaggataatggggtctcctccccagtattaatagaaaatctctgagctgtttttttttgtttgtttgttttgtttttttttcctgagatggagtctctctctgtcggccaggctggagtgctgtggcgcgatcttggctcactgcaagctctgcctcccaggttcacaccattctcctgcctcagcctcccaagtagctgggactacaggtgtccaccaccacgcccagctaattttttgttatttttagtagagatggggtttcaccatgtcagccaggatggtctcgatctcctgacctcgtgatccgctcgcctctgccttgcaaagtgctggagttacaggcgtgagccaccgtgcctggcctggtttttttgttgttgttatttatttatttatttatttattttttgagacagactctcgctctgtcgcccgggctggagtgtagtggcacgatgtcggctcactgcaagctctgcctgccaggttcaagccattctcctgcctcagcctcctgagtagcagggaccacaggcgctcgccaccacgcccggctaattttttgtatttttagaagagacggggtttcaccgcattagccaggatggtctcgatctcctgatgtcgtgatccgcccacctcggcctcccaaagtgctgggattacaggtgtgagccaccgtgcctggcctgatttttttttttttttaatctggtctcatacctctgacagctcatgaagaagtgctcctgcttcatatgtatatgtgttagcatagtgttaacatagcataggtgttcggtgtttgcagtttctgtttgttttatatgaattaaggtgtattatgagcagttgaagatatataggaaattttttcccaaaccactatctctgctcgttctattcattcagtctgtttatgttattccttcattcattcattttatagaacagtggagtgcctactgtatgcatctattgttctgggtcctggggaagaaaacaaagttcctgctttcatggaacttacattatattggcggagacagtaacagacaaacaaatgtagcctgtgtacatgtgttacatgaaaagcagggtagggggctgggagagagtagtagggagtgctattttcgaggtggttgtcaggaaaggcctcactgaggaggtggcattttgagtagacctgagcgcagcgggggcgtaagcccaggcagcatgtggaggaagagtgttcttggtgaaaggaacaaggatagaggcccgaagctagagagctcagcatgatcaaggaacagcaagccccgtgtggctggaatggagtgagcaaaggaatgagcagtagaaggtgagtgagttgggaggtcaccagagaccatggcaaggacttgaaagtgtcagggacacattggaagttggagcagggaaatgatgggatttatgttttgtttttgttttatgtttagtgtttttaagggattgctctatcagctatttggaaaatttagtgtagggcttcaagaagagaagcagagaaacaacattcttgccatagtcatagtctaagtaagggatgatggtggtgtggattaggctggtagtggaagaccagtccagttcgggttgtatttgaaggtagaggcaaaaagattatatttctaccagcaagcccatctatgaagttacttgtattattaatttaattgagacatgcccacataaactaataaataggaatttctgcagtttggttaaacacccctgtatatcctggttcttcttttagttgtccagatgtctctttaagtcaagtattttttggtggtgtaggagcctagagattgaatttattcacccaaaaggcatttgagtgattactatgtgccaggcactatgctgaatgccaaggatgtaaataagagggcgtagtctcagtctgttttactccagcttggttcctttttaatgaccctgacttgttaagcatatcagttatcctacagaatgtttaatcttctgtactttcctggttgtgttatttagcttatttctctttccttgacatttcttgtaaactggaagttacacctatagtcttgatgattcgtgttacacattttagattagaacacatcatgtgttgtatatggtgtttttgaaagcctctctgtatattggtctgtacattaaaatgttgcctgaatggatacacataaaatttaacagtgattacattagagatgagaagaaagaggtgccttttacttttcaatataccttttcctctgctttttgaactttcttgccctatgcatacgttattgcttaatcatccacctcatctcttcccctgtggctttctgttgcatttggaatgaaatctagcctctttgctgttacctgtggatgtcccttgctggcctctatcaccttactttgaaccactcctttcatggactgagctctcattggactatcttttattcttttgctgaagtttcttcactttgagtgcctctgcagttgctatttcatggctgtggcaagccctgccatggctttcatgcaaggatggttcctccttctcatctcaatattatctcttcagagagggaccttcccaactccgatgatctaaaatcctttgtatataccactcactaccacttctttcttttcttttccttttatcttttttttttttttttttttttgagatagggtcttgctctgttgcccaggctggaatcacgactcactgcagcctcatcttcttgggctcaaatgatcctctcacctcagcctctcgagtagctggaactgcaggcacacaccaccatacttggcttattattttactttttgtagagacagggtttcaccaaggctggtctcaagctcctgccgcaagcaatccacatctctcagcctcccaaagtattgggattataggagtgagccactactcctggcctattttcttattcactgtctaaaattatcttgttcatttatttacatacttgtttatagcttatttctcagctggacatggtgcctcacacctgtaatctcaatactttgggaggctgggttggagaattggttgagcccaggacttcaagaccagcctgggcaacaaagtgagaccctgtctataaaaaattgtttaaaaattagctgggcatggtggcacatgcctgtggtcccagctacttgggaggcagaggtgggagaatcgcttgggcccaggaggttgaggcgacggtgagccatgattgtgccactgcactctagcctagtgacagagtgagaccatgtgtctaaaaagtaaataaaaatagtttctctttcatgactagaatattacctctatgtgggcagggagtttgtctatactatttggcactatatttcctgattctgaaattatgcctagcacatggtaagtactccttaaatatttattgactgaattatttaatacttaagaatttcatttgggattatctgagtggtaagattacggattatatttatgtaagaaaaaatcattttttaaacttggttgccctttgccacactgacatagacactaagttttcttagccagattacttccgaggatactcacagaggccattctcttctcaatccccaaataattgatatttcttagcactttcaagctaatgcaattcttagatgatgtatctgtgtatatcatatcctcattctacaaatgtagaaattgaagtctgggcacagtggctctcacctgtaatctcagcagtttgggaggccaaggcgagcggatcactgaggacaagagttaagaccagcctggccaacatggtaaagccttgcctctattaaaaatacaacaattagggccgggcgtggtggctcacgcctataatcccagcacgttgggaggccaaggcaggcagatcacgaggtcaggagttcgagaccatcctggctaacacagtgaaaccccatctctactaaaaatacaaaaaattagccaggcatggtggcacgcgcttgtagtcccagctatcgggaggctgaggcaggtgaatcccttgaacccgggaggcggaggttgcaatgagctgagattgcaccgctgaactccagcctggtcaacagagggagactctgtctcaaaaaaaaaaaaaaaaaacaattagccaggcgtggtggcgggtacgagtacctgtaatcccagctactagggaggctgagggaggagaatcacttaaacccaggaggtggagtttgcagcgggctgataatgcaccactacattccagcctgggcaacagagtgagactctgtcttaaaaaaaaaaaaaagaaagaaagaaattgaggaatgtggagattgtggtctgtgatttgttaggaatcacacagcaggttagtagcaactacagggctttggttcagaataccaccttgacaatggtttgtttacagttcggctccccttcctctgcctttctctccttccttattgagggcagctggaaagaattttcatcatttactagcctatagctttaatttgagttttgaaaccttgataatagagcacagaggaaaagactgagttttctttttttgagacagtcttgctctatggcccaggctggagtgcagtgacaccatctcagctggttgcaacctctgcctcccaggttcaagcaattctgcctcagcctctcgagtagctgagattacaggcacgtgtcaccacgcccagctaattttctgtttttgtttcgttttgtttttttctgagatggagtcttgctctgtcacccaggctggagtgcagtggtgcgatgttggctcactcaaacctctgtctcctgggttcaagcaattcttctgcctcagcctccccagtagctgggactacaggtacgtgccaccatccctagttcatttttgtatgtttagtagagatggggtttcactatgttgaccaggctggtctcgaactcctgatctcaggtgatctactcgtctcagtttcccaaagtgctgggattattggcacacgcctatttttgtatttttagtagagacggggtttcaccatgttggttagactggtctcaaacttctgacctcaagtgatttgcccgccccagcctcccaaagtgctgggattacaggcgtgagccaccgtgcccagccaagattgagttttgaaaagagccttctgagattatgagaagggcaagcaagataacttaagaagttacattaaaatcatctaagagacagtgtaacaagaaggaattgtaaaatgatgttatgagcacgtgcccaatgtagtggcaatcccttgtgcttcgatacattggtgggagacaaaactgtacttaaattgataaatcccttacatgtcattttaaggagcttagactgactcccatcatgtagacatcagagatttcttttttttttttttttttttttttttttttttttgtgacagagttttgctcttgttgccgaggctggagtgcaatggcgtgatctcggctcaccacaacctccacctcccaggttcaagcaattctcctgcctcagcctcccgagtagctgggattacagccatgcaccaccacgcctggctaattttgtatttttagtagagacggggtttctccatgttgtggctggtctcgaactcctgacctcaggtgatcctcccgcctcagccacccaaagttctgaaattacaggcgtgagccaccgcgcccagcccagagatttctaaacagagttctaaccagatgcttttccctgtcagtagaatgagaatgaattggaggtgggagagactggcatgagggacaccagtcagccagtggaattagctggtaatgttgataggagaagaaaaagattcaaagttaggtagtggtagcaagaattagagggaaggtcggatttatgatatgtccaaggttgaattctaaggtgaaatttggtggcagatttcatgtgtaaattgggaaggtagattgagtttttttaacatgggttttctaacatgtcaatagagtgactctgcaggggggcctgacgagagaacagtgcatggggtgattcaacagccagttgagccttcatgcagagcatttaacactgtgactctgtagactctggttggcagtaaaatttcattaaaccaatatttaaacccttaggtaataataaaaattgagggaaaaggatccaggttttgtattttttatgaattcagttattgaattaaacaggaccttgcctcaagaaataatctaccaacaattaacttgttttaaagcaaagttaggaagtgagcatgttcaaattattaaataaaaaagtaagctgtgtatttcattcatagaaatagaggctggcctacttcggatgattctcagcatgtgattacagatgtgggcttatacatcctagggagttaaggcgtactctggcttggatagagtagagctctttgaaactcttctctcacccagctagtttatatagactagagaactagaatgtagcagcatactctgtcttagaagcccttttatataggagctggtctggaaggtttgaaaacataacaaatgtgttggtgtctcccaatgtattgctagattcttacccaagagcattatcctggttagggtttggtttggttttgttttgttttttaatgtttgccacaaactaacactagatgttagttctttcatcaagtgaggagagtagaagaaaagtccagaactctgaaacaccttttcaaaagtttttcaagccatgatgtttgcaagttaaatgctctgttatgtaagcaatataatcagtttttattaatgtaacattccttagtgttttggggtatcacacaaaaaagaatatccatatctggaagcaacagcttttaaataagagcattgtggtggtggtggtgatagtggtttttttttttttttttgagttggagtctcgctctgttgcccaggttggagtgcagtggcacgatctcagctcgcttcaacctctgctcccaggttcaagcaattcttctgcctcagcctcctgagtagctgggattataggcacctgctaccatgcctggctgatttttattattttagtagagacaggtttcaccatgttggccaggctggtcttgaactcttaacctcaggtgaatcacccacctcggcctcccaaagtgctggaattacaggcatgaaccaccatggccagccaaataagagcatttttaatgtaaaattatgcatgaaatgtacattcaattttgtctttgtttactaggatccatgttctcacaagctatgaagaaatgggtgcaaggaaatactgatgaggtaaatcctacctttaggataaaaagatttctgtttataagtgccaccctcatgtaagtgaggtttaaaattttccttttctttaggtcccatgtttaagcagcatggcacatttatgttctcttacccagaatgtaccaagaaagggtggtcccttcttaacatctaacaattgcctggtagtagcagtgaaggtatcttcagtcagaggctaggaccactgaaggatatacatgcattcaagtttccatcagccagcaggcatcagtaatcagtgtgtagatcaaaagctcaaatgtttccttccccactggcagttttacttcaagtagtggaggcttgcttttttaatagttaattaagtacattgagagatgggaggtgaaaaaaggaaaatgttttattttgaccatctaatatgaaagtagttcggtgttaggtatccagtagttgacactggaagacagggaatgacatgttaatattcatagccagagggtggcccaggttttttcgtacatgggaatgaaattcttatccaaataagtagaaattatgtgcgtaagccatttgttaagagcactgagtatgtgcatctcgatccatctaatgaataaccattatcaccagtttaaattattttctttaggcccaggaagagctagcttggaagattgctaaaatgatagtcagtgacattatgcagcaggctcagtatgatcaaccgttagagaaatctacaaaggtaaggatgacttcgttttgtgtaaactaaaaagtattattttccaggtgtaaaaataaaaaagaacataaggggtttctttgcctttgaaggattaactgctgtggggattaccttcttatcataagcaactagaaaattgacaaactaaatgaaacaactgtttgcatatattggacaatgggcaatacagggaaaccatggaaaccaaacagagcccagtagtcttgctgaacgaaagagttaaatatcaaagttcaggccaggtgcagtggctcacgcctgtaatcccagcactttgggaggccaaggcgggtgaatcacttgaggtcaggagttcaagaccagcctggccaacatggtgaaaccctgtcttagccgggtgtggtggcaggcacctgtaatcccaactatttgggaggctgaggcaggagaatcgcttgaaccagggaggcggaggttgcagtgagccgagatcacaccactgcactccagcctgggcgacgagcgaaaccccatttcaaaaaaaaaatcaaagttcagagagctcaatttgagtagaagttgtaggataaggtagcagaaaagaggaagctgcccagaaagaaagccgtagagatatttagagagattcccatggatccttggcctaggagtgatctgtatatgtgtggggtgaaaacgcatgtgtccaggtagagaaccccccagaaattagtaggctgaatgattgctggaacatagggctaagaaaagttcatggccagaaggatctggccagagtagagagacttagtaatacacaaggcattgggtagtgtcttcacagaggttatgccttactactgaagataaattagtcctagagtacaagcacctgaaccaagtttcaaagcaaatttttaaagggtcaaattacctaacaactgcatgccaaaacaaaggcctaaccctctttacagtaacacaacaaaattcagcacttcacagtgtaaagttagaatgtctgacgtccaggctgggcgcagtggctcatgcctgtaatcccagcactttgggaggccgaggcaggtagatgacctgaggtcaggagttcaagaccagcctggctaacatggtgcaaccccgtctctattaaaaatacaaaaacttagccaggcatggtggccggcacctgtgatcccggctacttgggaggctgaggcaggagaattgcctgaacccaggaggtgaaggttgcagtgagccgagatcgcaccactgcactctggtctgggcaaaaagagcaaaactcaggctcaaaaaaaaaaaagaatgtctgacgtcaatcacaaattaccaagcatgacatgaagttgacctataaccaggagaaaactcaatctatagaaacagacccagatgtgagaaagatgatgaatttagcagacaaagaccatcaagtggctattttaaatattaaaaatatgttcaagtggccaggtgcagtggctcatgcctgtaatcccagcactttgggaggccaaggtgggtaggagttcaagaccagcttggccaatatggtgaaaccccttctctactaaaaatacaaaaaaattagctgggcatggtggcaggtgcctatagtcccagctatatgggaggctgaggcacaagaatcacttgaacccgggaggtggaggttgaggttgcagtaagccgagattgtgccacttgtactccagcctggacaacagagtgagactctgtctcaaaaaaaaaaaaaaaaaagttaaagaaaacaagagtataatgagaaaaatgcaaaatagttttaaaagaaccaaatggaatttcttaaaataaaaaataccagaaatgggggccgggcgtggtagctcacgtctataatcccagcactttgtgggggctgaggcaggcagatcacctgagatcggtagttcaaggccagcctgaccaacatggagaaacctcatctctactaaaaatacaaaattagctgggcgtggtggcgcattgcctgtaatcccagctacttgggaggctgaggcaggagaattgcttgaacccgggaggcagaggttgcggtgagctgagattgcaccagtgcactccagcttgggccacaagagtgaaactccgtctcaaaaaaaaaacaaaaaaaaacagtagactcgaagaactagctgagtttttctttactttaggcagtaagtgtgaccttttgcaggtgactactttagttcctcatgtcctcattagtagatcagagaaattcgacaccaaaaccccaaaagaaaaaccccttctaatcctcattccatgattttatgaatgcatgaagtcctaggcctgcgaaggaatactcattctctttatcctgtgttgatacctctctgcttcaacctccaactcgacatttgcctataggatgtacttggacattcagcataaactacctcacaccattactgaattgcttcatgtgcacatgtcccatgccacaataccggggaccttgtcttccgtgatatttgtccgcagtgctgtgactacaggagggagtcagtgaatgtctgcatgtgtgtctttaccatccctcttgaatatgctctagggttaattcctagaagtagaattactctattgaaaattggcaatatttttcattctaatatctattgccaacatgggaaagcaagtctggatgccagtccttgttatatgccccttgggtaagttacgtaacctctttaagcttctgttcactcatattttaacaaggaaaattacaatattttacctcacaaaattgtagtcagcttctggctgtcttaaactctggtatatagtaaacactaagtgttggtgtccatccttaatttgtaataataggtcacttgttagagaaatgcaccttaccattttcttttcttttcttttttcagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaaaatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggcaactcttgctgcctctgcatgttttggaataacaatttctacaagactctaggctgtttaaactagtgctttcagttaagataaattctaatcatttctttgtatatacattttgtgcttctgagctagagatgccaagtagttgtaaactgcttataaagagaatagcagcaaatttgagactcggctacttttttctgccccacctgctttgagacacagaagcggagtgtggcccgaaattattagccagatttaatatttgatctaaagtaggtccttgtactcattttaaagttggaatttgattcctccaacattgagcacccaccatgttccaggctctgtgcattgtgcccacaaaataagattccctggtggagtttttatgggttcaaataatcagttgaacacccttcatctttatcatgttgttgacattgacacaaattgtttaaaaagaaaagatattagagagaaagtggtacctttgtaacttgatgtgtcttcatcattcggtaagatttgatgaaagtaaaaagcaaatgtcagccaaatccagtgaacagcaataaaacagggagtaactttttataactttttctacttggatttcaacattcagtagagcttttcgaaatgtaagtagtttacagtactggaggtttgactagttcagtaggaatttggaggggaaggtcattctgaattgtaacaaagtacaaacttctttgctgttttatttaagtactgagagctaagcacctgatgaagtgactgacctctctccagtgacagtgtttgggtacctgcctgacttcaggagtggggtttatgtttctacacagtgaccttttctctcgccctctcctccctcttgcccacacaccagttgattggacctgggttgaactcctgatccagacaggcccaagacagttcttaatgttaagaattttggggccgggcacggtggctcatgcctgtaattgcaacactttgggaggccgagacaggcggatcacttgaggtcaggggttcgaggccagcctggccaacatggtgaaaccctgtctttactaaaaatacaaaaattagctgggcatggtggcgcacgcctgtaatcccagctacgtgggtggctgagacaggggaatcgcttgaacctggaggcggaggttgtgcaatgagccgagaccgtgtcactgcattccagcctgggtgacagagggagactctgtctccaaaaataaaaataagaaaaagaattttgggctaggtgcagtggctcacgcctgtaattacagcattttggaaggcccaagatgggcagatcacttgaggacaggagttcgagaccagcctggacaacatggtgaaactccatctctactaaaaagacaaaagttagccagatgtggtgatgggcacctataatcctagctcctcgggaggctggggcaggagaatcacttgaacccaggaagcagagattgcagtgagccaagatcacatctctgcactccagcctgggcaacagagcaagactctgtctcaaaaaaaaaagaatttggccaggcgcagtggttcacgcctgtaatcccagcactttgggaggccaaggcaggcagatcacgaggtcaggagatcgagattgtcctggctaacatggtgaaaccctgtctctactaaaaatacaaaacattagccgggtgtggtggtgggcacctgtagtcccagctactagggaggctgaggcagaggaaggatgtgaacccaggaggcggagcttgcagtaagccaagatcgtgccactgcactacagtctgggcgacagagtgagactccgtctcaaaaaaaaaaagaattttggccgggtgcggtggcacatgcctgtagtcccagcactttgggagaccaaagtgggcggattacctgaggtcaggagttcaagaccagtccggccaatatggcgaaaccctgtctcttactaaaaaaaatacaaaaattagccaggtgtggtggcgggcacctggggaggctgaggcagggagaaatgcttgaaccggggaggcagaggttgcagtaagccaagatcgtgccactgcactccagagcaagactctttctcaaaaaaaaaaaaaaaagaattttgcatggggaaggagagatactgttcaccatctggaatggtgcttggatgtggcacttacaaaatcaggagccagcactgcatggacaaacagaagcatgtgggcctgagatagcaggtaccttgataaccctgaagacatccttggtttctgcatctattcctgcatccttgcattggactacattaatctgtcagttatccttataatgatttttgattttttttttttgagatggagtttcgctcttgttgcccaggctggagtgcaatggcacgatctcggctcaccacaacctccacctcccaggttcaagtgattctgctgcctcagcctcctgagtaactgggattacaggcatgcgccaccacacctggctaattttgtatttttagtagagacggggtttctccatgttggtcaggctggtctcgaactcccaacctcaggtgatcaccctgtctcggcctcccaaagtgctgggattacaggcgtaagccatggtacccggtctgttttttgattttttgaaaccagtctgaagtgagtttttttaattacgtgaaaggagtttggctaaaatactgccatactgccctaatgcctaatgattatgtattctcagcatgtctgcaaagtactgctgatttctggagaataatttttctttagtaaacttcacttaagtcgtcatgtgtattctctcaaaatggtatcctaacctaatggagctaaaagacaccccttgtttttataacaagcagttactgaggcccaggaaggggagaagtccctggcttgtgagatgatcaccattagaactcaggcctgggccagtgccttttcatgcttctcagatccttccaaagaataatgaagattataaccgcttttagcaattgtaataaacccagaaatagaaagctttttggttagagtactggtagaagtttggcgggagagataatttttacaaaatttgtaaatacctgccaattctatatactaggcaaggtctctggccttgtaaaacccctcaaggttacaactttggtggcccacactaatagttacccactgaggccctctccgggtgaacattgagcactagaggaagcccctctgcttgggcaggactgggcgtggtgcagagtaggagcggtgatactgtggattctgggcaggtggagatggccagtgatgtccaataaaggacactggagggagcagtgtgagtaaaggccctgagggcattcatgttcagggagggttgctgcccactggcttgcttggcacacaggagagtgggtattcctgccttagtaactttatgtaaacaagtatttcctcagtctgttcctctcaaactgcctgctctggcacattcagaatgtcacagaactcacctggatgcattcagccccttgcctaaaggtgacagtgcatctccttccccaccccacccctcataccactgaagcacctgtcagactggcccagtctgtgggcaaggagcctagagagggcttagtttcagcttgaaaggagctgggatttaccaagaagcaaatgagagacgaggattgcaacaactgtgccatttccccagcttcagctgactcctgtatattgactgtgccttcagactcatccgtaagtgaccccaggctggcctctcccacatcacagtaagaattccacacaccatacaacttggaaagaggctccagctgaaggaagccccacacttctttcaagtttttcttagtcttctcttcttggcaaagagtaccttttgtttcttctaattatgtaactattggtttagtaaatattcacccattcagtcaccctgtaagtggcaggcactgtttacagggacacaggaaggaataaaaacttgcaggcaccttggagcttgcattctattgaagaggtaatggaagttgggatagcagctaaactatgctggtattggccaggcgcagtggctcacacctgtaatcccagcactttggaggccaaggtgggcagatcatgaagtcaggagatcgagaccatcctggctaacatggtgaaaccccgtctctactaaaagtaaaaaaaaaaattagccaggtgtggtggcgggcgcctgtagtcccagctacttgggaggctgaggcaggagaatggtgtgaacccaggaggcgaagattgcagtgagccgagatggcaccactgcactccagcctgggtgacagagcgagactctgtctcagaaaaaaaaaatatgctggtagttttgattcaagatggcctttggagcccatgatttaggtctcgtacccaccaaggtctactggaaaacatcaggctctcctgctatagacccatagggagagctgcagccgagagggggagctgaagagaagtgccccttctgtgtcctgtcagcctcatccttccgcaaggaccagttgctgtgccactccattcacttgctgcaagactggaggtttttcctcaggtgttgagcacctggtttacaagatgtcagcatcttgatgcctgagaccatcaaggcaagtctctgaacagggcttaccttagagtaaggcttagaagaggccgtaaagtcagtctcagctccgtggctctgcagagctttgggacatgtgaattcttaaaaacaagactattgtacagttactatatgcatgcagtataaaattataaccttggaaaatcctagctagctgttgagctaattccataaagtaatcagctcctgagttctgcagtggtaataataatcagcataatgagtaaacactgtgtgtgccaggcagcgtctcatttgatccttgtgataatcttgtaagtactgattttctcccttctttaaacaaagttttttttttttttttagagagggtctcactatgttgcccaggctagtcttgaattc

SEQ ID NO: 14 - DNA, 162025 bp, Homo Sapien
  allele 129600: Nucleotide sequence of chromosome 17 containing the genomic sequence of the allelic variant AKAP10-7
gaattcctatttcaaaagaaacaaatgggccaagtatggtggctcatacctgtaatcccagcactttgggaggccgaggtgagtgggtcacttgaggtcaggagttccaggccagtctggccaacatggtgaaacactgtctctactaaaaatacaaaaattagccgggcgtggtggcgggcacctgtaatcccagctactcaggaggctgaggcaggagaattgcttgaacctgggagatggaggttgcagtgagccgagatcgcgccactgctctccagcctgggtggcagagtgagactctgtctcaaaaagaaacaaagaaataaatgaaacaattttgttcacatatatttcacaaatttgaaatgttaaaggtattatggtcactgatatcctgtttcattctttatataatcattaagtttgaaatgtatacttgcactactaacacagtagttaatcttagtcctacaagttactgcttttacacaatatattttcgtaatatgtatgcactggtgtttatgtacgtgtttatgtttatatctgttaaaattagcagtttccatctttttctattttgtaccatcacatcagttcagaaggattgacagagcaaaatgatttgatgaagtataaaagtcacatggtgagtggcataaatacaactctgaacaattaggaggctcactattgactggaactaaactgcaagccagaaagacacatatcctatatgtcaagagatgtaccacccaggcagttaaagaagggaagtacacatagaaagcacaatggtgaataattaaaaaattggaatttatcagacactggattcatttgctcctaaagtcagagtcctctattgtttttttgtttttgtgggtttctttttaaatttttttattttttgtagagtcggagtctcactgtgttacccgggctggtctagaactcctggcctcaaacaaacctcctgcctcagcttcccaaagcattgggattacagacatgagccactgagcccagcccagacgctttagcatttatgaagcttctgaaatagttgtagaaaccgcataagctttccatgtcactttcaaagtttgatggtctctttagtaaaccaaccaagttattcctcaagggcaaaataacatttctcagtgcaaaactgatgcacttcattaccaaaaggaaaagaccacaactatagaggcgtcattgaaagctgcactcttcagaggccaaaaaaaaaggtacaaacacatactaatggaacattctttagaagagccccaaagttaatgataaacattttcatcaaagagaaaagagaacaaggtgttagcaaattcctctatcaaataacactaaacatcaaggaacatcaatggcatgccatgtggaagaggaagtgctagctcatgtacaaaccagtagataatttcaacttgctgccgaatgaaacctctttgcaaggtatgaatcagcacttctcatgtttgttttgctttgttttgttttgtttttagagacaggcccttgctctgtcacacaggctggagtgcagtggcacgatcagagctcactgcaacctgaaactcctgggctcaagggatcctcctgccttagcctcccaagtagctgggactacaggcccaccatgcccagctaattttttaaattttctatagagatgggatctcactagcacctttcatgtttgatgttcatatacaacgaccaaggtacaatgtggaaaagggtctcagggatctaaagtgaaggaggaccagaaagaaaaggggttgctacatagagtagaagaagttgcacttcatgccagtctacaacactgctgttttcctcagagcagagttgatgatctaaatcaggggtccccaacccccagttcatagcctgttaggaaccgggccacacagcaggaggtgagcaataggcaagcgagcattaccacctgggcttcacctcccgtcagatcagtgatgtcattagattctcataggaccatgaaccctattgtgaactgagcatgcaagggatgtaggttttccgctctttatgagactctaatgccggaagatctgtcactgtcttccatcaccctgagatgggaacatctagttgcaggaaaacaacctcagggctcccattgattctatattacagtgagttgtatcattatttcattctatattacaatgtaataataatagaaataaaggcacaataggccaggcgtggtggctcacacctgtaatcccagcacttcgggaggccaaggcaggcggatcacgaggtcaggagatcgagaccatcctggctaaaacggtgaaaccccgtctactaaaaattcaaaaaaaaattagccgggtgtggtggtgggcacctgtagtcccagctactcgagaggctgaggcaggagaatggtgtgaacctgggaggcagagcttgaggtaagccgagatcacgccactgcactccagcctgggcgacagagcgatactctgtctcaaaaaaaaaaaaaaaaaaaaaagaaataaagtgaacaataaatgtaatgtggctgaatcattccaaaacaatccccccaccccagttcacggaaaaattctcccacaaaaccagtccctggtgccaaaaaggttggggaccgctaatctaaataatctaatcttcattcaatgctaaaaaatgaataaacttttttttaaatacacggtctcactttgttgcccaggctggagtacggtggcatgatcacagctcactgtagcctcaatcacccaggccccagcgatcctcccacctaaacttcctgagtagctgggactacaggcacgcaccaccatgcccagctaatttttaaattttttatagagatgggggtctcaccatgttgcccagactggtctcaaaccctgggctcaagtgatcctccctcaaactcctggactcaagtgatcctccttccttggcctcccaaagtgctgggattacaagcatgagccactgtacccagctggataaacattttaagtcgcactacagtcatggacaatcaggcttttcaacatgcagtatggacagtgagtcccagggtctgcttttccatactgaaatacatgtgatactaaggagaaaggtgctcgcaaggatatttaaaatgaagaatatttaaaatgaggaaaaaactgtttcttcatgactttgataaggctgataaagaccatttctgtgatctcaggtgattcactcaagtagtatatttcagtaatcattatctggaacagcctgaatcttaaccaaaataccatgattttttaatgctgttatgataccttgatgatatgaccaaactgcaatgtaggcagctaaatctccacgagtttgacttccccgagagttgacagttttcttcacaaattaaagaaatatattttttgatacatgattggcatatttaaaaactacactgaaatgctgcaaaatgatataaagaaacattttccagaatcaaatgcaatcaaagagtggattaggaatctactcaccattatcaactaaatagaaacacttggactgggtgtggtggctcacatctgtaatctcagcactttgggaggccaaggcaggtggattgcttgaggccaggagctcaagaccagcctgagcaacatagcaaaactctgtctctacaaaaaaaaaaaaaaattaaccaggcatggtggcagatgcttgtaatcccagctactctggaagctgaagtaggaggactgcttgagcccaggagatcaagactgcagtgagccgtggtcatgctgcgccacagcctgagtgacagagagagaccctgtctcaaaaacaaaaacaaacaaaaaacacttaaccttcctgttttttgctgttgttgttgttgtttgtttgttttgagatggagtctcactctgttgcccaggctggagtgcagtggcgtgatcttggctcactgcaagctctgcctcccgggttcacgccattctcctgcctcagcctcccgagtagctgggactataggcgcccgccaccacgcccggctacttttttgcatttttagtagagatggggtttcaccgtgttagccaggatggtcttgatctcctgacctcgtgatccacctgcctcggcctcccaaagtgctgggattacaggcatgagccaccgcacccggccaacctttctgttttttagtttgatatgcttgttaactcagcagctgaaagaatgctgaaagtggccttcagtaaaaaaatttcactagaatctctacatccatatttaatctgaatgcatatccagattgatcagttagagcaaaaacactcatcatcattcctgatgacctctaattctggtttcggctttctatttcaatggaaacagaataaggaaagaaatggaagggctctggaaatttgtcctgggctatagatactatcaaagatcaccaacaataagatctctcctataaatataaaacaagtataattaattttttaattatttttttctcttcagaggattttatttcaagataaaacataacttctacccatactattgattccaaaggttagaaaaagtgtttttcctcatcttatccttcaaagaggtcacagcaatgcaaacatctataaaatgcctctgcataattgtcagaagctatagtccagaaatcattgaaaatgcttttccattttaagcttaggtgaggtgtcttaggaaacctctatgacaacttactctatttattgggaggtaaactcccagactctcccagggtctcctgtattgatctcattttttaggcttcctaatcccttgaagcacaatcgaaaaagccctggatctcttttctgcacatatcatcgcggaattcattcggcttccagcaagctgacactccatgatacaagcggcctcgcccttctccggacgccagtccttgctgcggttagctaggatgaggggtttgctgggcttcagtgcaggcttctgcgggttcccaagccgcaccaggtggcctcacaggctggatgtcaccattgcacactgagctcctggcaggctgtaccaattttttaattatttaatatttatttttaaaattatggtgaatattttggtattctgctctaaaataggcccataaatgcacagcagatatctcttggaacccacagctttccactggaagaactaagtatttttcttttaaagatgctactaagtctctgaaaagtccagatcctctacctctttccatcccaaactaagacttggaatttatgagagatctagctaacagaaatcccagacacatcattggttcttcccagagtgcagtcctcctaaagaggctcagccctaagcaggcccctgcaccaggagggtgggtctgagacccacatagcacttcccaaggtgcatgctccagagaggcactgaaacagctgagcacaagcctgcaagcctggagaactctcacagtcagaacggagggggcccagtgggactaacataaagagaaaagggaacacagagaaatggatggcaccaacaaccagcaaagccttcatggccaatgaaagcatcagtgacggggccagaaccctcatccccaaagactcttcactgcctttagtgaaaaacaatggctagagagtgaagttatgatcatgtatagagaggtaaagttacatttttatattctgactctgctaatgtgaaattccctatctgctagactaaaagtttcagacaccctgttcaaatatcccattagttgctagagacttaaaatgaacagaacgcacattgtcaggatgactattaccaaaaaatcaaaagacagcaagtattggtgaggatgtagagaaactggaacttttgtgcactgtttatgagaatgtaaaatggagcagctgctgtggaaaagagtatgcaggttcctcaaagagtaaaaccaagatgtggaaacaactaaatgcccatcagtggatgaaggggtagacaatatgtggtatatacataccatggagtactattcagcctctaaaaaaaaaaaaggaaattctataacatgcaacagcatggatgaatcttgaggacattttgctaatgaaataaggcagtcatagaaagacaaatactgcacgactccacttatatgagataccaaaaatagacaaattcatagaatcaaagagtacaatggaggttacctggagctgcagggcgggaaacgaggagttactaatcaacgaacataacgttgcagttaagtaagatgaataagctctcaagatcagctgtacaacactgtacctagagtcaacaataatgtattgtacacttaaaaatttgttaagggtagattaacaaatgtagtagatccacaaatgtggttaagtgttcttaccacagtaaaataaaaaaagaatatcaagcccaggagttcgagactagcctgggtaacatggtgaaaccctgtctctacagaaaatacaaaaattagccagctgtggaggtgcactcctagggaggctgaggtgggaggcttgcttgagcccaggaggtcaaggctgcagtgagccatgattgcaccactgtactccagcccagatgacagagcaagacaccaccccccccaaaaaaagaaaaagaatatcaaacattttaaaagatcagatacgcaagaacaacaacaaaaaagagatgaacagagcatcgaccctcatctagtgggattcttggtctaactgaaaaacagacattgagagacaaacaatgacagtgatgtgatcacagcaattacacaggtatcccctggggactgcagaagaaaggaggaatgcctaactttcagaaaatagagaaagcgtcaaacagttggtgaaagccttccaaaactagagagaactgcacacaccaaatcacagaaagaagaaaagccgtgggagattctgggacccaccggctatttttgatggctgaacaccctgctgcaggagagacaggagctggaaagcatggtgggatgaaacctcaaacagctttgcctgcattgcttaagatgactgggcttgattaactctagtcaatggggacaattcaatcaaagaagaaagatgctcaaattcacattttagaatgattttttatggcagtatggggaatagattaaaagagagtgaagctggaggcaagaaacttgttaagaggcaactgaaacagtctagatgataaataataaactgacagagtgactagaaaaatcagaacaggctgaatcaacagatacctagatgaaaataacaggacttgatcaccagttgtatcttggagaggaaggagttgtttccttgctttccctacgactgggaatacggaaggtttgccgtgtgtattggttatatactggtgtgtagccaatcactgacaaccatttagcagcttaaaacacaaaggcttatctcccagtttctgtgggccaggaatctaagataggcttagctggctggttctggctcagagtttctcaagaggttgcaatcaagatgtcagctggggttgcatcatctgaaggctcaactggggccggagggtccacttccaaggagttcactcacctgcctgacaaggcagtgctggttgttggcaggagatctcaattcattgccaagtgagcctctctatagcattgctggaacatcctccccatctggcagttggcttctctcagcatgagtgatctgagagagagagcaaggaggaagccacagtgttcttcctactcctactcctaacactatggacctactcctaacactctcacttctgccttattccattagttagaaagggaactaagctccacctcttgaaataagaagtgtcaaagaatttgtggatatatttaaaaatcatcacactgtggaagtggatagggggttcaattaatgctgaacttgaaatgcctgagacattcaaatgtccaacaggcaatgaacatacccatagatggtcatgactttagcaagaatagaggaagatcacagaattaaggaggaattgaaaggtaaaagaagtggagtcagattccccctgaaaagtgagccatgaaaggaactttaactattgagttagaggtcagagtaggaaatttcggtggaattcttttttaaagaaaggaaccatataagcatgttttgaggtagagggagaataaatcagtagacagggagaggtaaaaaacataaatgataggggatagttgacaaaggtcttggcagaatcccttacccattgacttggggccaagagagggacacttctttgtttgagggataaggaaaataagaaagaatgggtgctatttagtgtggtcctgtctctagggcaaacgcataggtaacaaactgtgtgtgttaggaatatagatgtgacctcacattgagattctcacctcaaatccattttgttgttacctgtaccttcctaccttctctttttgctacatgcagactgctgttttgtcttcctggcctgttccaggtttcagcattctggcatatctgctaccctgttcccaaacctctctagagtccatgctccttccttggatagtgtttgattgggccacgtatctaagaagtgatgccttcagttaggcctgagaacctcctctatggaaatctccatcagtgaccctgacagacttggtatcttggagatgtcactgctcccagcctgtggtctaggagaatctcagcctgggcctctagtagtatggataaggcgttaaggtatctttgaaccagagtctgtcatattcctcaatgtgggacagataaaacagtggtagtgctggtgtttctgagctagaactctggtttttggtctagattctttgatgtatgacctttcagaggtattaaaatttgttctaatacaatgttcaatacaaatgtagttccttttctgttaggacctcaacaaaacatgaccaactgtagatgaacattaaactatgacaattcatggaaatgaatacagtaatacctgcggttcccccattttagcagtcactatggtgacatttggcacaaatggctatttaagggtgcttttgttaaaacctaccatcttactaggcacatgatattgaaactaatgaaataatggagaaacttcttaaaaacttttaatgaataaagtgatgaagtgataatattttagctgctatttataaagtgactattacaggtcaaacattcttctagggtttttttgttgaagttgtcacatttaatccttaataacccactatgagtcaggtattcttctctcccctttggacagttggggaaatgggggtcagagaggttaggtaatttgctcagggccacacaacctgcatgtagaaaatctgagatttgtacaggaacgtatcaaactctgaagtccatgcttctattttcccatgctgcctttctaataaaaggtaactaatgctactggatgctgcccccaaagtgagtcactttcaccccaccctacttgattttctccataaaactaatcacatcctgacaacttatttattgctgatctcccccactagattataaactcaataaaagcaagatccttgtctgctgaatatcagtacctaaaacgctgtctagcacagagcaagtaattaatatttgttgaatgaacaaataaaggaaaaaaattcaaaggaagaaaaagccctaaaacagatgtttacctaaacatacattttaaaagaaagcatataacaaattcaggacagaatttaaatttgattttttaaagaaataaccaagtgctagctgggcacagtggctcacacctgtaatcctagcactctgggaggccgaggcaggcagatcacttgaggtcaagagttcaagaccagcctggccaacatggtgaaacctgtctctactaaaaatacagaaattatccaggcatggtggcaggtccctgtaaccccagctactcaggaggctgagtcaggagaattgcttgaacccaggaggcagaggttgcagtgggccaagattgcaccactgcactccagcctgagtaacaaagcaagactctgtctgaaggagaaggaaagaaagaaggaaagaaggaaagaaggaaagaaggaaagaaggaaagaaagaaagaaagaaagaaagaaagaaagaaagaaagaaagaaagaaagaaagaaagaaagaaagaaaaagaaagaaagaaagaaagaaccaagtgcttatttgggacctactatgctatgtttttccatgcacgctattttcagtaaagcagttagcaaacttgcaagatcataacaacaaatatatgcttctataactctaaaattgtgctttaagaagttcctctttaccagctcatgtatgcattagttttctaagagttactagtaactttttccctggagaatatccacagccagtttatttaaccaaaggaggatgcttactaacatgaagttatcaaatgtgagcctaagttgggccagttcatgttaatatactccagaacaaaaaccatcctactgtcctctgacaattttacctgaaaattcattttccacattaccaaggagccagggtaggagaatatagaaagaccacccaagaatccttacttctttcagcaaaatcaattcaaagtaggtaactaaacacatgccctaacaatgaatagcagattgtgctcagaagaatgatctacaacatcttactgtgaaggaactactgaaatattccaataagacttctctccaaaatgattttattgaatttgcattttaaaaaatattttaagcctaaattttaaaaggtttgatattggtacatgaatagacaaacagacatggactagaccaagaattaggttcaaacatatacaggaatttaatatacgataaatctagtattccaaaggaaccaacaaatggtgttcagacagcaggataggcatcaggaaaaacacagttgggcaccctaccttactcctaacaccaggagtaactgaaggagcaccaaatatttatttattttaattatagttttaagttctagggtacgtgtgcacaacatgcaggtttattacataggtatacatgtgccatgttggtgaggagcaccaaatatttaaaagaaaaaaattggccaggggcggtggctcacacctgtaatcccagcactttgggaggccaaggtgggcagatcacctgaggtcgggagttcgagaccagcctgagcaacatggagaaaccccatctctactaaaaatacaaaattagccaggcatggtggcacatgcctgtaatcccagctacttgggaggctgaggcaggagaatagctttaatctgggaggcacaggttgcggtgagctgagatattgcactccagcctgggcaacaagagcaaaacttcaactcaaaaaaattaataaataaataaaaataaagaaagaaaagaaaaaaatgaaaatagtataattagcagaagaaaacaccgtagaatcctcggactcttaggatggggaatgcctataatataaaaaccctgaagttataaaagagaaaatcacctacatacaaaccaaatctttctacatgcctaaaacatagcacaaacacagctaaataatcatagctgaatgaactgggaaaacaaaacttgactcatatccagacagagttaattttcctacacataaagagtacctatataaacccaacaaaaaaaccaccactaacccaaaataaaaatgtgacaggtaatgaacaggtagttcacagagaatacaaatggctcttcggcacataagatgctcagactgacttttacttatttattttttgagagacagggtctcacgatgttgcccaggttaggctcaaactcctgggctcaaatgatagtaccaggactacaggtgtgccccaccgcacctggctcctcaaccacctgtattaacaggaaatgcaaaataaaactttcaaatctattttacctattagaatggcaaaaatttgaaaaacttcaaacatcatcatgttggtgagaatgtgaggagactggcactctcattttttgctgatagcatatatatactgatggcttctatggaaagcaatctggcagcgtctatcaaatgtacaagtgcatatatcctttgacaaagcaattccactctaggaatgtgttctatatggttgtgcttcctggggctgggaactgggagctaagggacaggggcagaagataatcttcttttccctccttccccgttaaacatgttgaattttatatactgtaatatattatttttcacaaaagataatttttaagcgatatgtctgggaatttttttttttcttttctgagacagggtctcactctgtcatccaggctggaatgccatggtatgatctcagctgactgcagcctcgacctcctgggttcaagcaatcctcccacctcagcctcctgagtagctgggactacaggcacgtgccatcatgctaatttttgtatatacagggtctcactatgttgcccaggctaatgtcaaactcctaggctcaagcaatccacccacctcaggctccaaagtgctgggattacaggcgtgagccaccgcgcctggccctgggaattcttacaaaagaaaaaatatctactctccccttctattaaagtcaaaacagagaaggaaattcaacctataatgaaagtagagaagggcctcaaccctgagcaacaaacacaaaggctatttctgagacaggaatttgctgaacaaaatcgagggaagatgacaagaatcaagactcacttctcggctgggcgcagtggctcacacctgtaatcccagcactttgggaggccgaggcggacagatcacgaggtcaggagattgagaccatactggctaacacagtgaaacccagtctctactaaaaatacaaaaaattagccgggcgtggtggcaggtgcctgtagtcccagctacttgggaagctgaggcaggagaatggcgtgaacccaggaagcggagcttgcagtgagccgagatcacgccactgcactccagcctgggtgacagagcaagactctgtctcaaaaaaaaaaaaaaagactcatttctctagatcttgagccgtattcaaatttatctcagcttagtgagaggttaaagcaaggaatatccttccctgtgggccctgctccttactgaaggaaggtaacggatgagtcaaggacaccaatggagaaaagcactaacaccattatctgatgaacattacgtgaagaagggtaagaagtgaagtggaattgctgaagaagtcagtgaaagcggacattcatttggggaaatggaatataggaaatccataaaagtgattaaaaagatgttagaggctgaggcggggggaccacagggtcaggagatcgagaccatcctggctaacacggtgaaaccccatctctactaaaaatacaaaaaattagccaggcgtggtggcaggcacctgtagtcccaactactcgggagactgaggcaggagaatggcatgaacctgggagacggagcttgcagtgagccgagatcacgccactgcactccagcctgggtgacagagtgagactccatctcaaaaaaaaaagttagatacgagagataaagatccaacagacacacaactgctaattctgaacagaacaaaacaaatggcacaggaaaagaaaatttaagatataacaccggaaaactttcctgaaattgagtaactgaatctatagcttgaaagggtttagcatatgccaagaaaaatcagtagagtccaaccagcacaagacacatctagcaaggctggtgattctaccaacacagagaaagaagtgggtgacccataatgcggaaaaaggcagaccatctgcagtcttctccagaacactggagtctgaagacaaaagaatgctgcctactgagccagaagggagagaaagtgacccaacacatctttaccaagttagaatgtcacgcattatttaaaggctgcaaaagccatgaaagacatgaaagaacacaagcatttacaacatgaaagaacacaagcattctcatactcaagaatccttaagaaaaatgtagtcctaatccagcccactgaaagttaaatgtacttaatgtgctcattaatgggaacttcatagcttcaaatcagtctggtcccatctaccaacatctctcgcccggctttcctgcaatagtcagcacctttccctcctcccagtcttgtcccctggagtctgctctcagcatagcagagtgaccacatcaacacccaagtcagagccctccagtgcgcactggtctacaaagcccttcccaccccccaccccacgtgccctccggatccttgtgacgtgtctcctgcataccctagcagccctggcctcctcactgcccctcctgtacatcaggaaggcgactccttgagtcttggctctggccgcctcctccacctgcagtgagttaactcccttacctactctaggtcattgctcaaatgtcagcatctcaatggggccctccctgactaccctatttaaattctacatactccccttgaccccatggacctcactcaccctattccacttttattcttacaatttagcacttgttctcttctaacgtattctaagacttactcatttattacattgtttgccaccccctctagtacataaactccagaggggcagggatttctgtctatttattcatttctttatccctaggacatagaacagggcatagttcagagtattcaatgttatcaatgaatgaactagcagtagtaccagttccagttaggcacagaattaaatctaaatagaattaaatctcatggtctgggttaactatggatagaaaattagatataattttaagaagcctagaaagaaaaaattaataatgtaaaaataatattaatttgataataataacaaaaactctgccaggcactgtggctcaaatctgcaatcccagctactcaggaggctgaggtggaaggatcacttgagaccagagttcaagactcagcctaggcaacacggcaagaaactgtctctaaaaaaattaaaacttaaatttttaaaaaagaattctcaaagcgtcacaaaaactggagattaaggtacaggaagtgtgaagtaatattactatgctaatggttttttttttttttagaaaggtataaccaaaagatttctttctcaagtcgataaactgagaaagataagcatatcttccaattaacagagggggaggaaaagccagatacaacaaaataagatataaattagtttccagttgaaaacaagagtaggagttattttgcatcacctcacctgtgacctcccccagcccaaaaaacactactgataaacagggtagaaaagcatcatctcagataaagcaggaaaaactgccacagtctcaaaccacaaactataagcacacacctggccaaccctgccaagtctgggctcagtaggaggaacgtgctgagagctaggatgtaccaacttagacattctgtgggatacagatgtccctggaagggtcacaccatctcaaaggcacctgtaatgcccactgattacagccaccatatgtgagagagaaactcagggcacttagagagtataacaagaaccttatgtcatctgagatgaggaatcctcagccctgcaaattaaccaactctttagaacaactggcaaaacataaatatccacaacttttgtttcagtaattccactcttagatatcaatccaaagtacatgagacagcagatacacacacaaaatggtatttactgcagcattgtttataatagcaaaaaacaagaaataatccatatgtctcaataggatactgggtacatgagggtatgtacccatcattcaaccatcaaaaagagtgatatggatgtccacagatggacataaaaagctgtgtgttacgtgaaaacaaactcaagcagcagcaggatgggcttatgatagtcagtatgagctaatttctggaaaaaaaaatctagtgtgtgcacagaaaacatctgaaagaacagaaacaaaactatcagcagaatattgagatgttttactaagttgtatatctatactgcttgtaatttttaccccaagcaagaattactttttggaaaaagaaaattcaggaaataaagcatttctttaaacttcatgtttaaacaaatggtgatggaataaaagagttcttattcatcataaacacacacagcacacatgcacgcatgtgcgtgagcacaccctttacttgataaataccatgttgaatattttagtctttccttttaggttctatcccttcactcaaaatgcggttataaataaatgtacttttcatgtgccttctgcctaaacccactttaatataactttacagtcccattatcattatagtctcaaagctagactcagcctgaaactaccctttcatttggaacccttattaaaatgccacatacagctccttcaaataaaaacaaaccctaggacctgacactaggcttcctttgttgctactcataatggccaagttctgtgcttataatacatcttctttcattttattgctacatatccaagggttttatatgtttttcttattatatcttaattcaaaacaccatcacgctcttttccagatgaaaataaggaaaagaaattgagcaactgactgacttaaaggtcataaaactatatagtagcagagtcagcaaaagaagaaacacacatctcccaagtagaggctgaaaaccagtaccattcacctccagggtgagctatatacagattacaaagtcaccttctctaaatgttcaaactgaatcccatacccatactttaccactacctcgtaagaacagcctcagatcttgttatagccttttttttagcatgctgaagccaataaaatgcttcccattcagcaagagaaacaagttctgaaacactgaataatctgcccagggcctatgaacatttccactgtgagaaatgttctccactgtgtggagaagatccttactcttctccacacaggcagaacattagaaaaattcttggattctatgatgcacagcttaggagtctgtttagcacaatttaagtccaaatagttattaaatcctcctctgttccagaaacagtgctaaatactgtgaatataaaaattgaaaagatactctcctggctcccaagaaagtcagccagatagaggagacacaggcacacaaatcactgtcacatgaagctctacctccctaacttcaaacgagggcctaagtcaccaagaatacagtagcagttgtgactacgagtaactactataattcaatactttatcttcccttagaaaactcttctcccttggaaatttatttgcatttctaaataccattccttactaaaaggaagcagggctccttggggaaatagctgattctaggtgtggactatgaaatgaaaatggtgagtctgggacatcccatgttgcccagaaatcaaggaactgcccaaagattaacagagtcatgttaaatggacctaagagtgaaccagaaggagctcactttgccccgcgtggaacaatttcaagaaaaacatgacagtaatgaattataaaacatgaattaaaatacatattggtactaaaaagagaacaaaaggatgtggctttggataaagctcttcttcatggaagaataccagctaataaatgtaaaggaaatgagagaattagaaaaattatcattttgtaaaccttaatatattcacctagacatgctaaaaccactgagtaaaaggctgcttgggaagaggatgctcacatgatctcagagtttcacaccacagataatttattagatacaggaaggaagatgtgatcaagcttcctgtgacccccagccaggccccacaacactatgtgcctccttgtgatgtgggagctacacagcatcgcccacacagcttctcgccaaaactgtttgaagctaatcacaagggaagaactggacagcttctgaccatgagacgctccaccagacaacttgcttggcctctccaaagaaacttgcttggcctctccaaagaaaactcagtttcatttaaaaacaaaactaattatttaaaaacaaacgaaaagcaagttgtggacttgagctccagggacagagcagacatacttttccctgttcttcccagtaagtggtaataaaaaccctcaacactagatataaaacaaatataagaaggttctggaaggggaagaggaggcagactatccaggtgccttgaggcccacagaacaacccagtgatgggttcactgggtcttctttttgcttcattatctcagacttggagctgaagcagcaggcaacttcaaaacaccaaggggcacagattgaaaagccccaagaaaagcctgccctctctagccaaaggaccaggaaggagacagtctaatgagatggaacacatttagacagtaactgcccatttaccagcaataactgagcagggagcctagacttccagtcttgtgaggacgtaccaaggtacccaacacccccaccaaggctgagtaaggactgcgacttttatccctgcatggcagtagtaaggagcccatccctcacccgccagcagtgtcaggggaacctggacttccactcccacccaggagtgatgaggccctccctgctggggtcatgtcagaggaggcctagtggagattcagtgacttaaccttttcccagagataatgaggccacctttcctccctcttcccccatggtgacagtgaaagcactgtggcaagcagtaggcactcctacccctcctagccagggaggtatcagggaggccaagtagggaaccagaatacccacaaccacccagcagcaacaggggtcccccaccccattgggtgtcaatggaagcagagcggaaagcctggatatttacccccatctagaagtaacaagctgatgtcccccttcttctactacaatggtgttcaaaacaggtttaaataaggtctagagtctgataacgtaatacccaaatcgttgaagttttcattgaggatcatttataccaagagtcaggaagatcccaaactgaaagagagaaaagacaattgacagacactagcactaagagagcacagatattagaactacctgaaaggatgttaaagcacatatcataagcctcaacaggctgggcgcggtggctcacgcctgtaaccccagcactttgggaggccgaggcaggtggatcacaagatcaggagatcgagaccatcctggctaacacggtgaaaccccgtctctactaaaaatacaaaaaaaaatagcaaggcatggtggtgggcacctgtagtcccagctactcgggagcctgaggcaggagaatggcatgaacctgggaagaggagcagtgagccgagatcgcaccaccgcactccagcctgggcaacagagcaagacttcgtcccaaaaaaaaaaaaaaaaaaaaaaaaagcctcaacaaacaactacaaacgtgcttgaaacaaatgaaaaaaaaatcttggcaaagaaataaaagatatatattttggccaggtgcagtggctcacagcctgtaatccctgcactttgggaggctgaggcaggcggatcacctgaggtcaggagtttgagaccagcctgaccaacatggagaaaccccgtctctactaaaaatacaaaattagccagtcatggtggcacatgcctgtaatcctagctactcaggaggccgaggcaggagaatcgcttgaactcaggaggtggaggttgcggtgagccgagatcccgccattgcacattgcactccagcctgggcaacaagagcaaaactccatctcaaaaaaatagatacatattttaatggaaattttagaattgaaaaatacagtaaccaaattgaatggaaagacaacatagaatggagggggcagacaaaataatcagtgaacttcaacagaaaataatagaaattacccaatatgaagaacagaaagaaaatagactggccaaaaaataaagaagaaaaaagaggagcagcaggaggaatgatggaaaaagagaaaggaaggaaggaagggaaggagggagggaaggagtgagggagaaagtctcaaagacctctgagactaaaataaaagatctaacacttgtcatcagggtccaggaaagagacaaagatggcacagctggaaacgtattcaaaaaataatagctgaaaacttcccaaatttggcaagagacataaacctatagattcgaaatgctgaaccccaaataaaaagcccaataaaatccacaccaaaatacatcatagtcaaacttctgaaaagacgaaaagagaaaacgtcttgaaagcagtgagtgaaacaacacttcatgtataagggaaaaacaattcaagtaacagatttcttacagaaattaaggaagccagaaggaaatgacacaatggttttcaagtgctgaaagaaaagaagtgtcaacacaaaattctagattcagtaaaaatatccttcaagaatcaatgggaaatcaagacagtctcagataaagcaaaataagagaatatgttgccagcagatctcccctaaaggaatggcaaaaggaagatcatgcaacagaccaaaaaatgatgaaagaaggaatccagaaacatcaagaagaaagaaataacatagtaagcaaaaatacatgtaattacaataaaatttctatctcctcttaagacttctaaattatattgatggttgaagcaaaaattataaccctgtctgaagtgcttctactaaatgtatgcagagaattataaatggggaaagtataggtttctatacctcattgaagtggtaaaatgacaacactgtgaaaagttacatacacacacacacgtaagtatatataaatatatgtgtgtatatgtgtgtgtatatatatatatacatataatgtaatacagcaaccactaacaacactatacaaagagataataaccaaaaacaatttagataaattgaaatggaattctaaaaaatattcaaatactctacaggaagacaagacaaaaagagaaaaaaagaggaggacaaactaaattttttaaaaacataaataaaatggtagacttaagccctaacttatcaataattacataaatgtaaatgatctaattatatcaattaaaagacagagatagcagagttaatttaaaaacatagctataagaaacctgctttgggctgagtgcagtgactcacacttgtaatcccagcacttcgggaggccaaggcgggtggatcacctgaggtcaggagttccagaccagcctggacaacatggtaataccccatctctactaaaaatacaaaaaaattagccaggcatggtggcacacgcctgtagtcccaactactcaggaggctgcgacacaagaactgcttgaacccgggcagcagaggtagcagtgggccaagattgcgccactccagcctgaacgacagagtgagactccacctcagttgaaaaacaaaaaagaaacctgctttaaatataccaacatatgttggttgaaattaaaagaataaaatatatcatgaaaacattaatcaaaagaaaggagtggctatattaataacataaaatagacttcagagaaaagaaaatttcaagagacaggaataaaaggatcaagaaaagatcctgaaagaaaagcaggcaaatcaatcattctgcttggagattcaacaccctctcttaacaactgatagaacaactagacaaaaaaatcagcatggagttgagaagaacttaacaccactgaacaacaggatctaatagacatttacggaacactctacccaacaatagcaaaataaacattcttttcaagtattcactgaacatatccttagaccctaccctgggccataaaacaaagctcactagtgattgccgaaggcttggatggacagtggaagagctgcatggggagggagaaggtgacagttaaagagtgtaggatttctttttgggataatgaaaatgttccaaaattgattgtggtgatgttggcgcaactctacaaatataaaaaaggccattgaattgtacgttttaagtgggtgaaacatatggtatgtggattatatctaacgctttttaaaaacttaacacatttcaaagaatagaagtcatacagagtgtgctctactggaatcaaactagaaagaggtaactggaggataacgagaaaagcctccaaatacttgaaaactggacagcacatttctaaaatcatccgtgggtcaaagatattcatttctgatattcatttttattgtttaatgtatttttaaaaatttcttaagggaaataaactgactaaaaatgaatatggctgggtgcggtggctcacgcctgtgatcccagcactttgggaggccgaggctggtggatcacaagatcaggagttcgagaccagcctggccaagatggtgaaaccccgtctcaactaaaaaactacaaaaagtagccaagcgcagtggcgggagcctgtggtcccagctacttgggaggctgaggtaggagaatcgcttgaacacaggcagcagaggttgcagtgagccaagattgtgccactgcacgccagcctgggcgacagagactgcctcaaaaaaaaaaaaaaaaaaaagaatatcaaaatttgtgggacatagttaaagcaatgctgagagggaaatttataacactaaatgtttacattagaaaagagaaaaagtttcaaatcaatagtctccactcccatctcaagaacacagaagatgaagagcaaaataaacccaaagcaagcaaaagaaagaaaatataaaaataaatcagtaaaattgaaaacagaaacacaataaagaaaatcagtgaaacaaagtactgattcttcgaaagattaataaaattgacaaacctctagcaaggctaacaaacaaaaaagaaagaagacacggattaccagttattagaatgaaagcataattagaaacaactctacacattataaatttgacaatgtagatgaaatggactaattactgaaaaaacacaaattaccacaactcacccaatatgaaatagataattgggatagcctgataactactgagaaaattgaatttgtaattttaacactcttaaaacagaaacattaaacttaatattttataaatattagataaggtaattatacccttccttaacaaataaaaacgacaaattattttgcagctaaagagatgtatgtactgtgaaaaatatcttcagaaaaatagaactttgtttgaagaataaggatttaaaaaatgtttttaactctcaagaagcaaatatctgggcccagatggtttcactgaagaattctaccaaatgtttaatgaagaattaccaccaactctacatagcatctttgagaaaactgaagagaagggaacatctcccagttcattttatgaagtgggtgttactctgatactagaactgtataaggacagctactcttgacacactgcctatgggtagctctgctctgcaggaacagtcagaaaaaaaaaaaaaagaagcactggacaagggcagtataaaaaaagaaaactgggccaggtgcagtggctcacacctgtaatctcagcactttgggaggctgacgctggtggatcacctgaggtcaggagtttgagactagcctggccaacatggtaaaaccctgtctctactaaaatacaaaaattagccaggcagggtggtggggaaaataaaaaggaaaaaaaaacaaaaataaactgcagaccaatatccttcatgagtatagacacaaaactccttaaactccttaacaaaatattagcaagtagaagcaatatataaaaataattatacaccatgatcaagtgggacttattccagaaacgcaagtctggttcaacatttgaaaacaaggtaacccactatatgaacgtactaaagaggaaaactacataatcacatcaatcaatgcagaaaaaagcatttgccaaaatccaatatccattcatgatactctaataagaaaaataagaataaaggggaaattccttgacttgataaagcttacaaaagactacaaaagcttacagctaacctatacttaatggtgaaaaactaaatgctttcccctacgatcaggaacaaagcaaggatgttcactctcattgctcttatttaacatagccctgaagttctaacttgtgcaaaacgataagaaagggaaatgaaagacctgcagattggcaaagaagaaataaaactgttcctgtttgcagatgacatgattgtctcatagaaaatgtaaagcaactaggggtaggggggcagtggagacacgctggtcaaaggataccaaatttcagttaggaggagtaagttcaagatacctattgcacaacatggtaactatacttaatatattgtattcttgaaaatactaaaagagtgggtgttaagcgttctcaccacaaaaatgataactatgtgaagtaatgcatacgttaattagcacaacgtatattactccaaaacatcatgttgtacatgataaatacacacaattttatctgtcagtttaaaaacacatgattttggccaggcacagtggctcatacctgtaatcccagcattttaggaggctgaggcgagcagaaaacttgaggtcgggagtttgagaccagaatggtcaacatagtgaaatcccgtctccactaataatacaaaaattagcaggatgtggtggcgtgcacctgtagacccagctacttgggaggctgaggcacgagaattgcttgaacaagggaggcagaggttgcagtgagctgggtgccactgcattccagcctggtgacagagtgagactccatctcaaaaaaaataaaataaagcatgacttttcttaaatgcaaagcagccaagcgcagtggctcatgcctgtaatcccaccactttgggaggccgaggcaggcagatcacaaggtcaggagtttgagaccagcctgaccaacatggtgaaaccccatctctactaaaaaatatataaattagccaggcatgtgtagtctcagctactcaggaggctgaggcaggagaatcacttgaacccggaggcagaggttgcagtgttgagccaccgcactccagcctgggtgagagaacgagactccgtctcaaaaaaaaaaagcaaaataacctaattttaaaaacactaaaactactaagtgaattcagtaagtctttaggattcaggatatatgatgaacatacaaaaatcaattgagctggacaaaggaggattgttttaggtcagtagtttgaggctgtaatgcacaatgattgtgcctgtgaatagctgctgtgctccagcctgagcagcataatgagaccacatctctatttaaaaaaaaaaaaattgtatctctatgtactagcaataagcacatgggtactaaaattaaaaacataataaatactgtttttaattgcctgaaaaaaatgaaatacttacatataaatctaacaaaatgtgcaggacttgtgtgctgaaaactacaaaacgctgataaaagaaatcaaagaagacttaaatagcgtgaaatataccatgcttataggttggaaaacttaatatagtaaagatgccaattttatccaaattattacacaggataacattattactaccaaaatcccagaaaaattttacatagatatagacaagatcatacaaaaatgtatacggaaatatgcaaaggaactagagtagctaaaacaaatttgaaaaagaaaaataaagtgggaagaatcagtctatccagtttcaagacttacatagctacagtaatcaagactgtgatattgacagagggacagctatagatcaatgcaaccaaatagagaactaagaaagaagcacacacaaatatgcccaaatgatttctgacaaaggtgttaaaacacttcaacgggggaagatatgtctctcattaaagggtgtagagtcattgcacatctataggcaaaaagatgaacctgaacctcacaccctacagaaaaattaactcaaaatgactcaaggactaaacataagatatacatctataaaacatttagaaaaaggccacgcacggtggctcacgctcgtaatcccagcactttgggaggccaaggcaggtggatcacctaaggtcaggagtttgagaccagccggatcaacatggagaagccccatctctactaaaaatacaaaattagctggacgtggtggcacatgcctgtaatcccagctacttgggaggctgaggcatgagaatcgcttgaacccggggggcagaggttgcggtgagccaagatcacaccattgcactccagcctgggcaacaagagcaaaactccaactcaaaaaaaaaaaaaaaaaggaaaaatagaaaatctttgggatgtaaggcgaggtaaagaattcttacacttgatgccaaactaagatctataaggccagtcgtggtggctcatgcctgtaattccagcactttggtcaactagatgaaaggtatatgggaattcactgtattattctttcaacttttctgtaggtttgacatttttttagtaaaaaattgggggaaagacctgacgcagtggctcacacctgtaatcccagcactttgggaggccggggcaggtggatcacacggtcaggagttcgagaccagcctggccaacatggtgaaaccccgtctctaccaaaaatataaaaaattagccgggtgtcatggtgcatgcctgtaatcccagctactgaggaggctgaggcaggagaatcacttgaacctgggaggtggaagttgcagtgagccgagattgtgccactgcactccagccttgggtgacagagcgagactccgtctcaaaagaaaaaaaaaaaaaagaatatcaaacgcttactttagaaactatttaaaggagccagaatttaattgtattagtatttagagcaatttttatgctccatggcattgttaaatagagcaaccagctaacaattagtggagttcaacagctgttaaatttgctaactgtttaggaagagagccctatcaatatcactgtcatttgaggctgacaataagcacacccaaagctgtacctccttgaggagcaacataaggggtttaaccctgttagggtgttaatggtttggatatggtttgtttggccccaccgagtctcatgttgaaatttgttccccagtactggaggtggggccttattggaaggtgtctgagtcatgggggtggcatatccctcctgaatggtttggtgccattcttgcaggaatgagtgagttcttactcttagttcccacaacaactggttattaaaaacagcctggcactttcccccatctctcgcttcctctctcaccatgtgatctcactggttccccttccctttatgcaatgagtggaagcagcctgaagccctcgccagaagcagatagtgatgccatgcttcttgtacagcctacaaaaccatgagcccaataaaccttttttctttataaattatccagcctcaggtattcctttatagcaagacaaatgaaccaagacagggggaaatcaacttcattaaaataatctatgcagtcactaaacaaataagaacaagaggctccagaagtgggaagccaatacccagagttcctacaatacagtatctgaaaagtccagtttccaaccaaaaaatatatatatacaggccggacatggtagcttatgtctgtaatcccagcactttgggatgctgaggcgggcagatcaccctaggtcaggagttcgagaccagcctggccaatatggcaaaaccccgtctctactaaaaatacaaaaattagccaggcatggtggtggatgcctgtaatcccagctactcgggaggctgaggcagggaatcacttgaacccaggaggcagaggttgcagtgagccgagatcacgccactgaactccagcctgggcaacaaagtgagactccacctcaaaaaaaaaaaaaatatacatatatatatgtgtgtgtgtgtgtgtgcgcgcgtgtgtgtatatacacatacacatatatacatatatacagacacacatatatatatgaagcatgaaaagaaacaaggaagtatgaaccatactttctgtggttatgataggatggggtatcacgggggaagtagacaagggaaactgcaagtgagagcaaacagttatcagatttaacagaaaaagactttggagtaaccattataaatatgtccacagaattaaagaaaagcgtgattaaaaaaggaaaggaaagtatcataacaatattactccaaatagagaatatcaataaaggcatagaaattataaaatataatacaatggaaattccggagttgaaaggtagaataactaaaatttaaaattcactagagaaggttcaacactatatttgaactggcagaagaaaaatttagtgagacaaatatacttcaatagacattattcaaatgaaaaataaaaagaaaaaagaatgaagaaaaataaacagaatctcagcaaaatgtggcacaccattaatcacattaacatatgcatactgagagtaccggaagcagatgagaaagaggaagaaaaaatattcaaatgatggccagtaacttcctagatttttgttttaaagcaataacctatacaatcaagaaactcaatgaattccaagtaggataaatacaaaaagaaccacaaacagatacaccatggtaaaaatgctgtaagtcaaaaacagagaaaatattgaaagcagctagaggaaaacttataagagaacctcacttacaaaagaacatcacttataaaagaaccacaataatagaaacagttgacctctcatcagaaacaatgaatgataacatatttgaagtgctcaaagaaaaaaaataaagattcctatatacgacaaagctgtctttcaaaaatatacatccaaaaggattgaaaccagggtcttgaagagttatttgtacatccatgttcatagcagcattattcacaatagccaaaaggtagaagcaacccaagggtccatcgacaaataaataaaatgtggtatatgtatacacaatggaatttattcagtattaaaaaggaatgaaattctgacacatgctacaacatggctaaaccttgagaacactatgctaagtgaaataagccagccacaaaaggacaaataccatattacttcacttgtatgaaatacctagggtagtcaaattcagagatagaaagtaaaacagtggttgccaagggctgagggagggagtaacgtggagttattgttgaatgggtacagaatttcagttttgcaagataaaaagagttctggagacagatggtggtgagggtggtacaacaatacaaatatactttatactactgaacagtatacttaaaaatgattaacatggtgaaaccccgtctctactaaaaatacaaaaaaattagctgggtgtggtggcgggcacctgtaatcccagctacttgggaggctgaggcagcagaattgcttgaaaccagaaggcggaggttgcagtgagctgagattgcgccaccgcactctagcctgggcaataagagcaaaactccgtctcaaaaaataaaaaataaaaaaaatttaaaaatgattaagcaggaggccaggcacggtggctcacacctataatgccagcactttgggaggccgaggcaggcgatcacttgagaccaggagtttgagaccagcctggccaacatggcaaaaccctgtctctgctaaaaatacaaaaattagccaggcatggtggcatatacttataatcccagctactggtgagactgagacacgagaattgcttgaacccaggaggcagagattgcagtgagtcgagatcgcgccactgaattccagcctgggcgacagagcaagattctgtctcgaaaaaacaaaaacaaaaacaaaaagcaaaaccaaaaaataattaagcaggaaacgagattgctgctgaggaggagaaagatgtgcaggaccaaggctcatgagagcacaaaacttttcaaaaaatgtttaatgattaaaatggtaaattttatatgtatcttaccacaaaaaaaagggctggggggcaggaaatgaaggtgaaataaagacatcccagagaaacaaaagtagagaatttgttgccttagaagaaacaccacaggaagttcttcaggctgaaaacaagtgaccccagagggtaatctgaattctcacagaaaattgaagcatagcagtaaaggttattctgtaactatgacactaacaatgcatattttttcctttcttctctgaaatgatttaaaaagcaattgcataaaatattatatataaagcctattgttgaacctataacatatatagaaatatacttgtaatatatttgcaaataactgcacaaaagagagttggaacaaagctgttactaggctaaagaaattactacagatagtaaagtaatataacagggaacttaaaaataaaattttaaaaaatttaaaaataataattacaacaataatatggttgggtttgtaatattaatagacataatacaaaaataccacaaaaagggaagaagacaatagaactacataggaataacattttggtatctaactagaattaaattataaatatgaagtatattctggtaagttaagacacacatgttaaaccctagatactaaaaagtaactcacataaatacagtaaaaaaataaataaaataattaaaatgtttgtattagtttcctcagggtacagtaacaaactaccacaaattgagtggcttaacacaacttaaatgtattttctcccagttctggaggctaaacacctgcaatcaaggtgagtacagggccatgctccctgtgaaggctctaggaaagaatcctcccttgtctcttccagcttccagtggttctcagtaaccctaagtgctccttggcttgtagctatatcattcctagcaaccagaaagaagaaaataataaagattatggcaaaaaataatgaaatcaaaaggagaaaaatggaaaaaaataaataaaaccaaaagctagttctttgaaaagatcaaccaagttaacaaaccttttaactagactgacaaaaaggaggtaagactcaaattactagaatcagaaataaaagaggggacattactaatgagggattagaaaagaatactacgaacaaatgtgtgccaacaaattagaaaacttagatgaaatggacaggttcctaggacaacatcaactaccaaaatttactcaagaagaaagagacaatttgaatgagctataacaagggaagagactgaattgacaaccaagaaactatccacaaagaaaatcccaggcccagaagatttcactgtgaaattctttcaaacttataaatataaattaacatcagttcttcacaaactcctccaaaaaaaagaacagatctctatttacaggcgatacgatctttagaaaatcctaagggaactactaagacactatgataactgataaacaagttcagcaaggctgcaggatagaaaaccaatatacaaaaatctattatatttctatacacttgcagtgaacaacccaaaaatgagattaagaaaataattcaatttacaataacatcaaaaagaataaaaacactcaaaaataaatttattcaagtaagtgcaaaacttatactctagaagctacaaaacactgttaaaagaaattaaaggtttacataaatgaaaaactatcccatgttcatggatcaaaagacttattactggcaatgctctccaaattgatctataaattcaacaaaatccttatcaaaatcccagatgaggctgggggtggcggttcatgcctgtaatcccagcactttgggaggctgaggcacgcagattacctgaggtcgggagctcgagatcagcctgaccaacatggagaaaccctatctcttctaaaaatacaaaattagtcaggcgtggtggcacatgcctataatcccagctactcgggaagctgaggcaggagaatcgcttgaacccaggaggcagaggttgcagtgagccaagatcgtgccattgcactccagcctgggcaacaagagcaaaattccatctcaaaaaaaaaaaaaaaaaaatcccagatgacttcactgttgaaattgaaaagattattctaaaattcacatggaattgcaagaccttgagaatagccaaaacaaacttgaaaaacacgaacaaaatataggatgactcacttgccaattgcaaatgttacgacacagcaacagtaatcaagactgtgtggtactggcaaaagacacatacatacatacatatcaatggaatataattgagagtacagaaacaagcctaaacatctatggtaagtgcttttctatttttttctttttttttttcttttttgtagagatagaatctcaccatgttgcccaggctggtcttcaacttctgggctcaagcaatcctcccactgtggcctcccaaagtgctgggataactggcatgagccaccacatccagcccagatgattttcaaaaaagtcaacaagaccattcttttcaacaaataggtctgggatgatcagatagtcacatgaaaaaaaaaatgaagttggaccctccatcacactaaagtgctgcgattataggcatcagccaccacatccagcccaaatgattttcaaaaaggtcaacaagaccattcttttcaacaaataggtctgggataatcagatagtcacatgaaaaaaaaaatgaagttggaccctccatcacaccatatgcaaaaattaattcaaaaatgaattgatgacttaaacgtaagagttacgactgtaaaactcttagaaggaaacatacgggtaaatcttaaagacgttaggtttgacaaagaattcttagacatgacaccaaaagcatgaccaactaaggtaaaatagggtaaattgtacctaccaaaatgaaaaacctttgtgctggaaaggacaccatcaagaaatggaaagccaaaatagccaaggcaatattaagcaaaaagaacaaagctggaggcatcatactacctgacttcaaagcaacagtaaccaaaacagcatggtactagtagaaaaacagacacatagaccaatggaacagaataaagaacccaaaaataaatccacatatttatagtcaactgatttttgacaatgacaccccttcaataaatgatactaggaaaactggatatcgatatgcagaagaataaaactagacccctatctctcaccatatagaaaaatcaactcagactgaattaaagacttgaatgtaagacccaaaactataaaactactggtagaaaacataaggaaaaacgcttcaggacattggtccaggcaaagatcttatggctaaaacctcaaaaacacaggcaacaaaaacaaaaatggaaaaatagcactttattaaactaaaaagctcctgcacagcaaaggaaacaacagaatgaaaagacaacctgtagaatgggagaaaatatttgcaaactatccatccatcaagggactagtatccagaacacacaagtgactaaaacaactcaacagcaaaaaagcaaataatctggtttttatatgggcaaaagatctgaataaacattctcaaaggaagacatacaaatgtcactatcattctgccagtaccacactgtcttgattacttgttagtgtataaatttttaaattgggaagtgtgagtcatcctacactttgttcttgtttttcaagtttgttttggctattctgggagccttgcaagtataaaatagccaacaagtatgaaaaaatgctcaccatcactaatcatcagagaaataaaaatcaagaccactatgagatatcctctcactccagttagaatggctactatcaaaaagacaaaatataatggatgctggcaaagatttggagaaaggggaactcctatacactgtgggtagggatgcaaattggtaatggccattatggaaaataatactgaggtttttcaaaaaactgaaaatagaactaccatatgatccagcaaccctactactgggtatttatccaaaggaaagaagtcagtatactgaagaaatatatgcactctcatgttaattgcaacactgttcacaacagccaagacagggaataaatctaaatgtgcatcaacagatgaatggataaagaaaatgtggcatatacactcaatagaatactattcagccattaaagaagaatgaaatcctgtcatcccagcaacatggatgaacctggaggacattatatttaatgaaataagtaaagcacaaaaagataaacagtacatgttctcactcagacatgggtgctaaaaagaaaatggggtcacagaattagaaggggaggcttgggaaaagttaatggataaaaatttacagctatgtaagaagaataagttttagtgttctatagaactgtagggcgagtatagttaccaataacttattgtacatgttcaaaaagctagaagagattttggatgttcccagcacaaaggaatgataaatgtttgtgatgatggatatcctaattaccctgattcaatcattacacattgcatacatgtatcaaattatcactctgtacctcataaatatgtataattattacgtcaacaaaaaaaggaaaaaaaagaaaattaagacaacccacataatggaagaaataaaatatctgcaaattatatatatctgataaatatttaatatttataatatataaagaactcctacaactcaagaacaacaacaaaacaacccaattcaaaaatgggtaaaagccttgaatatacacttatctaaagactatatacaattggccaataaagacacgaaaagatgctcaacatcactagtcatcagggaaatataaatcaaaaccacaatgtagaatgtagacaccacttcatatgcactaggatggctagaataaaaaggtaataacaaatgttggtaaggatgtgaaaaaatcagaaacctcattcgctgctgttgggaatgtaaagtgatgcagccactttggaaaacagtctggcagctcctcaaattattaaatacagagttaccgtatgacccaggaatattcctcctgggtctataaccaaaaaaatgaaaacatatatccacataaaaacttgtacatgggcatttatagcaacattattcataacagcaaaggtggtaagaacccatatgcccatcatctgatgaacaggtaaataacatgcggtattatccatacactagaatattatctgcccatacaaggagtgacatccagctacatgctacaaggatgaatctcggaaaccttatgctaagtgaaagaagccagtcacaaatgaccacagattatgattccatgcatcggaaatgaccagaatagggaaatctatagagacagaaagtagattagtggttgggtggggctgggaggacaggtagtacactactttcccagaactactggaacaaagtaccacaaactggggagcttaaacatagaaattgatttcctcacagttctggagactaggactctgagatcaaggtgtcagcagagctggttctttctgagggccctgaggcaaggctctgtcccaggcctctctccttggctggcaggtggccatcttctccctgcgtcttcacatcatcttttctctgtgtgtgcccatgtccaaattttgattggctcattctgggtcatggccaattgctatgcacaaagtgaagtctacttccaaaagaagggaagagggaacactgactaggctaaacttatagtcattttaatgtccgcttttcctatgagattgtgaacacacagaagtagggtttttatctacattgtgcaaagtttaataagaaaaatagaattcaagagaagcagttcaatagcaggaatttaatatgggaactaattacaaggtttagggcaggactaaaaagccagttgggatggtgagccaacccagagattagcaacagtgggaccccatctacctaccacccatgaagctggaaggataaaggaggggctattatcagagtccacaagccagtgtcagagtccttggctggagctgggaccaccctagagacactgtgcaaagcagaaaacaagggggaaaaaccctgacttctcccttcctcccacctttcaatctcccactagtgcttcctactagccatacttggccagagacagtgacaaggaacactgcaaaatgaagtttgtaggaatcatctccctctgagacagagaaatatggaagggtagaaaatgaatcagaggataaagagaaaaaaccctgagtactatcttatttatctttgtatctccagtgcctaatctgtctctcaaaaaaggaaagcaattgagagaaactgaaaactccaattgaaatgaaagaatggagaattactggactagaagagaagagaaaaatttattccgcatagagtaaacaagaatggattcacaaaggacgtgatgaatgaaaagctataatcagcaaagatttgccagagaaattaaaaagtggtaaactcagccacgctgtacaacctgaaggcacaatgcatgaaaacgtttcaagaaatgacaagatttgaagtcaaattctaagtgcttttccagaatctctcaagacgattatatagctaccccattttattaaataaaatggaaacttactaaactttccccttgtattaaactaacatatgtcctaatagcaaacgattctggaattcctagagtaaaatatatttcgtcaaagtgtattgctcttttaatattctgctgacctccttttgctatttaggatatttgtatacacatcacacgtaaatttggtctatagtttacatctacgggcttatactgttctttttttcatttttttaaaatttccaacccccagtatccatatactgctctctatcagggttattttaactttgtaaaatcagctgagatgctttccatgttttttttttttattttctgccacatttgaatagcataggagttaccaccatcaaccttggattatttaagcattcacgattccacgtgtggattttttattcagagtctttcttgtcattcctgctatcagcacagaacccaatctcagctttccagctatactctcaccccatggaatttgcagatgaagttcaaaaggacctttgcattatcctgcctcgccctcttcccccttcatttagacatcaccttcttctagaacgtcttacctgacatgccctgctcccaacccctgctgcccaattgtgtgctctcccgtgtcctggcctgccatcctctttagtaattgcctgctccctcatctgtctccccacccagacattaagctgaatagactggatttgtgtcttgtccatcactataatctcagcacctagtacctagtaggtacttaccatgtattcattagcaaaatgttatgtataaccttgcaccttaaaaacaagagaaggaagacaaaattaagtcttaagactatggtttagaacatggatcagaaactacagtctgcagcccaaatccagaccaaatgaagagaccatgttcatttacatacaacctatagcagctttcacactacaggagcagagctaagtagttccaagggaacacacggccctgcaaagcctaaaatatttactctatagctcttcacagaaaaagttttcagatccctcgtttagaactcttgttcatatgcaatttcactaaaccatagttttttgggtttgtttggttttttttggcaaaaaggaatgagccgatccagaaaaggttgaaaagaatgaatcattactgctgaaagaatgtgcacacagtccgtcagtattctgctgccatgctgacacccatccaatagtgtcatgagatgcagcagctactactgtgttctcaatgccgagtccacccactccataaccatgtccaagcaatcttgggaacatcatcaccatgcttgtttatccttaaggtattgcctcacatacagcagtggctggtcataaagtcaaatgacactagtggccaggaggtcaagagaatgagtgaggacaggtgggtaggcagcccaggccctagcaacagcaggagctcacccctcagtcactctagccaggactgaaatacttttcaccctttcaagagagactaggaatctggatttttatgtgaaatatcttgattactaaatgttgtcaacagacatgtcaaaaggtaaaactaagtaagttcatggggcagattgactattcaggttatagaattaaggattcttatccaacacagataccaaccaaaaagctgacgtataacatattaggagaaactatgtgcactgtcgaaacatcaacaaggggctaatgtctaaaatagtctatattggattccagttgaaacatggggaaaggacatgaacaggcaacttatgtcaatggaaactcaaaaagataacaagcatatataaaagcattctcaaattcagtagtaaacagacagatgcaaataaaaagagggaaactgctgccgggcacagtggctcacacctgtaatcccagcactttgggaggccgaggcgggcggatcatgaagtcaggagatcgagaccatcctggctaacatggtgaaaccccgtctctactgaaaacacaaaaaattagccaggcgtagtggtgggcaccagtagtcccagctactcaggaggttgaggcaggagaatggcatgaacccaggaggcggagattgcagtgagccgagaccatgccactgcactccagcctgggcgactgagtgaaactccatctcaaaaaatataataataattataattataataataataaatagtaaataaataaaaagagagagactgctaaagtctagaaagttgaatgatgccaagcgcatgcaaagatcagggccttgggatggccgggtgcagtggctcacgcctgtaatcccaccactttgggaggccaaggcgggcggatcatgaggtcaagagatcaagaccatcctggccgacacagtgaaacccggtctctactaaaagtacaaaaaaatatatatatatatatatattattatattatatatatatatatcagagccttgggaatccttgtgtgctgctggggaaggtagtggtgcagccacccttgacagcaatctggcagtacttggttatattaagtataggcacacaccacgaccaggcagtcctactcctgggtctaaatcccaaagaattctcacacaagtccataaggagacatgtacgaggctcattcagcattactgggagtgggaatcaacctgggtgtccatctacaggagacgagatggacaaaatgtggtggatattaagaccagaatcaccaagtaacagagatgggtggtgagtgacaatcctaagatacagaataaaggctagaacatgatgccattcatgtaaattaaaaatagatgcacacaaagcagtatacgcgtgacccttgaatagcacaggtttgaactgcctgtgtccacttacatgtggattttcttccacttctgctacccccaagacagcaagaccaacccctcttcttcctcctccccctcagcctactcaacatgaagatgacaaggatgaagacttttatgataatccaattccaaggaactaatgaaaagtatattttctcttccttatgattttctttatctctagcttacattattctaagaatatggtacataatacacatcacacgcaaaataaatgttaattgactgtttatattatgggtaaggcttccactcaacagtaggctgtcagtagttaagttttgggagtcaaaagttatacacagattttcaactgtgcaggcaatcagttcccctgaccccctcattgttcacgggtcaactgtatatacacaaaagtattatatgaacctcattagaatagctgtctatagggagaagagaatgagagtgggataaaacggaatgaacaaataaaccaacaaatgcattaacaagcaaaacaacagaggggcttgcatgggccagtgatgataaagggctaagaatgagaatataattaattcaattcctcacacctgaggtctaaaaccaaggaaagggagggccaggcgtggaggctcacgcctgtaatcccagcactttgggaggctgaggcgggcggatcacaagattaggagtttgagatcagcctggccaacacagtgaaagcccatctctacaaaaaatacaagaattacccaggtgtggtggcacatgcctgtagttagctactctggaggctgaggcaggagaatcacttgaacccaggaggcggaggttgcagggagccgagatcacaccattgcactccagcctgggtgacagagtaagactctgtctcaaaaaaataaaaaaaataaaaaaacagagaaagggaggaaactagatccaggctgactagatacagcctttagagttagaaaagatgatttgacaatctaagcccacactcagattgaatgaaattgaaaagcctttcaaactaaaacatttaattacaccatctgctgcagacagaactcagacaactcaaacaggtaatgtcagcgtggtgttttatatcaccaccctcaacacagaataaaaatcagctgcatgtgaagcagtgactagaatgaagaaaaggctgcttcttacttccttctagtggttctttccgaaaacattaataggcaccagctctatgcatgtcaccctgcagggagacatggggtatataactatgacttactgttcattcctcaaggaattcccaatcttgtggaagattatacacaatgaggcaacaaaaactatccaataaaaccacggaaaagaagccagtgacaaagaagccagtgatgaaaggccctgtgagcagagctgatggccatttggggaagaaagaccaacatggatgggggtgatcagggtggctccgtgggaaagctggaagagaagtggcagatctctgagctggatgatgggccactaccatctgtatatggctaattaaagaccatgtgtggattttttattcagctctttcgtgtcattcctgctatcagcacagaacccaatctcaactttccagctatattgagctaaacttctcacctcatggaatttgcagataaagttcaaaaggatccttgccttttcaaaataattttgaatggttgagtagtccctctgtgctctctcactgacaccctctcaaggctgctgagcacgtgccatgctatggctttctccaacatcaggaaatgttctccactcagtttcaccttaatacaaatgtgttctctcttcagagaaggcaaaaaaattcatgaccatctgactgggagaagtcatttctaggtaaagtgtccatctttttctgaggaacacaggaggaaaatcttacagaaaagagttaacacagcaggcctaagactgctttttaaaataaataaataaataaataaataaataaataaataaataaataaataaataaatgaatgatagggtcttctgtattggccaggctagtctcaaattcctggcttcaagagatcctcccaccttggtctcccacagtgttgggattatagacatgagccattgtgcttggcccaagactgttattcttaaaaagtctcataaaaagcatggttaatccttggctggcacctgggaacttagatttcagaagggttcccaccatccaacctggaaagagggactcactgtgcctaaattattgtgtggtttatgctgaactcctgcttttcttcaggtagcgtggaatgtggtatgtgctgggcaaagggggcctgcatgaccagcccccaataaaaaccctgggtgttgggtctctagtgagtttccctggtagacagcatttcacatgcgttgtcacagctccttcctcggggagttaagcacatacatcctgtgtgactgcactgggagaggatgcttggaagcttgtgcctggcttcctttggacttggccccatgcacctttccctttgctgattgtgctttgtatcctttcactgtaataaattacagccgtgagtacaccacatgctgagtcttccaagtgaaccaccagatctgagcatggtcctgggggcccccaacacagaaataaattataaaagaccaaggactgggcatggtggcccatgccggtaatctcagcgctttgggaggccgaggcaggaggaccagttaagcccaaaagttcaaagttacagtgacctatgactgcgccaatgcactctaacctgggagacagagcaagaccctgtccccaaaacaataaactaaacacatacttctgccttccaagtgtcttaaaattcaatggaatggtagaaacatttttaaaacactaaatcaaaagaaacctggaaaacaagagtgccgatggccaactaaaatgtctaggaaatttctgaaaagtaaaaagtactcagaaccagattacctgagcaaaccatagcccaatacaagcttgggaggaggctgttatgcagaaggaaatggtaacaggtttccaggaacagacttgtaacagcagatagaacagcagaggtagaacctgacaaggtgattacctggggaactgcagtctgaatgaccaggactgttggacccttcccctcacatggaatacacacgccactcagcagcacaccacagctcttcaacaatcacaggaggcacgctacgcctagtaagacaggaaaaaaggaattctcaaacttcgaagatgaacacataaagaatcaccaagtttttattcagtatgatgaaacagggacactgaatcaacagaacacaaacccaagcaaagataattactagagcacatagaagaaattattagatattcttgggaagacctaaggggacattataaagagcaagcagttggtatgtgacgatctttgtgatataccaagaaataaaaacacaggatgaagaccagatagagaataatgctactatttgtgcaaaaaaggagaaatggagaatctgattcatatttgcttgtatttgcatgaagaaactttggaaggtacataagtaactaacaacaatggttacctacttgtaaggcgagagaagtaagaggacaggaatggtgggaacaccttttgtgtccggaattggtgggttcttggtctgacttggagaatgaagccgtggaccctcgcggtgagcgtaacagttcttaaaggcggtgtgtctggagtttgttccttctgatgtttggatgtgttcggagtttcttccttctggtgggttcgtagtctcgctgactcaggagtgaagctgcagaccttcgcggcgagtgttacagctcttaagggggcgcatctagagttgttcgttcctcctggtgagttcgtggtctcgctagcttcaggagtgaagctgcagaccttcgaggtgtgtgttgcagctcatatagacagtgcagacccaaagagtgagcagtaataagaacgcattccaaacatcaaaaggacaaaccttcagcagcgcggaatgcgaccgcagcacgttaccactcttggctcgggcagcctgcttttattctcttatctggccacacccatatcctgctgattggtccattttacagagagccgactgctccattttacagagaaccgattggtccatttttcagagagctgattggtccattttgacagagtgctgattggtgcgtttacaatccctgagctagacacagggtgctgactggtgtatttacaatcccttagctagacataaaggttctcaagtccccaccagactcaggagcccagctggcttcacccagtggatccggcatcagtgccacaggtggagctgcctgccagtcccgcgccctgcgcccgcactcctcagccctctggtggtcgatgggactgggcgccgtggagcagggggtggtgctgtcagggaggctcgggccgcacaggagcccaggaggtgggggtggctcaggcatggcgggccgcaggtcatgagcgctgccccgcagggaggcagctaaggcccagcgagaaatcgggcacagcagctgctggcccaggtgctaagcccctcactgcctggggccgttggggccggctggccggccgctcccagtgcggggcccgccaagcccacgcccaccgggaactcacgctggcccgcaagcaccgcgtacagccccggttcccgcccgcgcctctccctccacacctccctgcaaagctgagggagctggctccagccttggccagcccagaaaggggctcccacagtgcagcggtgggctgaagggctcctcaagcgcggccagagtgggcactaaggctgaggaggcaccgagagcgagcgaggactgccagcacgctgtcacctctcactttcatttatgcctttttaatacagtctggttttgaacactgattatcttacctattttttttttttttttttgagatggagtcgctctctgtcgcccagactggagtgcagtggtgccatcctggctcactgcaagctccgcctcccgggttcacaccattctcctgcctcaacctcctgagtagctgggactacaggcaatcgccaccacgcccagctaattttttattttattttttttttagtagaagcggagtttcaccatgttagccagatggtctcaatctcctgacctcgtgatccatccgcctcggcctcccaaagtgctgggattacagacgtgagccactgcgccctgcctatcttacctatttcaaaagttaaactttaagaagtagaaacccgtggccaggcgtggtggctcacgcctgtaaccccagcactttgggaggccgaggcgggcggatcacgaggtcaggagatcgagatcatcctggttaacacagtgaaaccccgtcgctactaaaaatacaaaaaattagccgggcgtggtggtgggcaccggcagtcctcgctactggggaggctgaggcaggagaatggcgtgaacctgggaggcagagcttgcagtgagccgagatagtgccattgccttccagcctgggcgacagagcgagactccacctcaaaaaaaaaaaaaaaaaatagagacccggaaagttaaaaatatgataatcaatatttaaaaacactcaagagatgggctaaagagttgacggaacaaatctaaatattagattggtgacctgcaaaaccagcccaaggaacatcccagaatgcagcccataaagataaagagagcatttccgctgggcacagtggtatggcaggggaattgcctgagtccaagagttgcaggtcacattgaaccacaccattgcactccaggcctgggcaacacagcaatactctgtctcaaaaaaaaaaaaaattaaattaaaaaagacagaatatttgagagaaaaaaatgcttatttcaagaaacatgaaagataaatcaagatattctaattcccaagtaagaataattccagaagcagaaaatagaatagaggcaaggaaacactcaaaacttctccagtgccatagaaatgtgtattaatctttagaatgaaacggactaccaaatgctgagcaggaagaacaaaagagatccactcttaagccagtgtggtgcccaagcgcagtggctcatgcctgtaatcccagcactttgggaggccgaggcaggtggatcacctgaggtcaggagtttgagatcagtcaggccaacatggtgaaaccctgtctgtactaaaaatacaaacattagctgggtatggtggtgcacatctgtaatcccaactacttgggaggctaaggcaggagaatcacttgaaaccaggaggtggaggttgtagtgagccgagatcatgccacactcccagcctgggtgacagagcaagattccatctcaaaaaaaaaatccactcctagacaaataatagttaaattttagaacaccaaggagaaagaaaaaaaattgtaaagcttcagagaaaataaacattaactacaaagaaacgagagtcagacgcgtgcacttcttcctagataccagcagataaagcaatatctccaaaattcagaaggttttaacgtagaatcctatacccagtcaagaatattcacatggaaaagtgaaataaaaaacattgtttaaacatgcaagggttcagaaagtttaccattcacagaatccctgaaaacaaaaccaaataatcacttaaggactcattaagaaaacaaatgaaataaaagcaccaatgatgagtaaataatcagaaaaatttacagtttacctaaataactgtttatgcataatgtatgaaaacccaaaaatttaatatgggacagaattaaaatcatgataagattcttttttgctttactcatggagagttcacataaacagattatcttttaatagcaagagaaaaaaatgtttagatatgtgtgaaaaactaagggtaccaaaacagtgcaaattcatttatcatcaggaaaatccaaattaaaaccacagtatccaccagaataactaaaaggtaaaagacagaaattaccaagagttggcaagaatgtggagcaaccacatatacttctggggtaaataagttggtgcaaccggtactgaaaactgtttgctagtatctactaaaaccgagcacatgcacagactacaaccaagcagttccactcccagatacacactcaacagaaatgcacacactcactcaacaaaagacgtgtactagagtgttcatgtacttactattcataatagtccaaaaatgcaaacaaccaactgccaatcaaagtcaaatgtatatctatattagggatatatacaatggcatatacacagcaatgagaatgaaatgaaccagctcggcacagtggttcatgcctgtaatctcagcactttgggcgggtaaggcaggcagatcacttgaggtcagaaatttgagactagcctggccaacacggttaaaacctgtccccactaaaaacacaaaaattagccgggcatagtggttgcaggcctgtaattccagctactcgggaggctgggttgggagaatcgtttgaacccgaaagccggaggtcgcagtgagcggagatcgtgccactgcactccagcctggacgatagagcaagactccgtctcaaaaaaggaaatcaaaaatataaaataagatgacaggaataatccgcaaaagatcagtaatcaaaataaatataaatgggctaaagctacctattaaaagacaaagatttcacacccataaggatagctactatcaaaaaaagagagagaataacagatgttagcaaggatgtatggaaactgaaattctcacgcattgctggtgagaatataaaatggttcagcctctgcggaaaacactatgctgggtcatcaaaaaattaaaaatagaagtactacttgatccaacaattctacttctgggtatatacccaaataactgaaagcagggtcttgaagagatatttgtacacccatgatcatggcagcattattcataatagctatgatgtggaaccaacataaatatcctttgataaatatatggataagcaaaatgtggtgtatacattcaatggaatattaattagcaataaaaatgaagaaaattctgacacatgctacaacatggatgaaccttgagggcattacattaaatgaaataagccagttataaaaagacaaatactatatgaggtactatattagatactcatgcaaggtacctaaaataggcaaattcatagagacaaaaagcagaatggtggttgccaggggctgcggtaatggatacagagcttcaattttgtaagatgaaaaaattctggagattggttgcataacaatgtgcacacacttaacactggggaactgtaaacttaaaagtagtaaatggtaaaaataaaaataataaataataaattttatgttattttaccacaatatttattaaaagacaaagattaactaattaaacaaaatccagccataagctaatggtaagagtaacaattaaagaagacacagaaaattgaaaatcagtgactagaaaaagatattccatataaatgctaacaaaaagcaagtacagcaatataaagagaatgaacaaaaaaaaaattaaataagatggctcgtttattcccaaaaggtacaattcaccaagaagatacaagaattgtgaacctttaagcacataaaacagcttcaaaaatacaacatttaaagaaaaatatatattaaacatagaaatagtacaaaaacccctacaagaatcataatgggagtcttcaatacaactctccatatcaacaggtcaaacagagaaaaaaaataagttaaggatgcagaaaacctgaattaccatcaataaacttgagattaatatagaactgtatacccaatatactaagagttcagggaacagtcgtgactgacagtggactgcaaattaatctgttcttaatctttgtttttctttcagcactgtggcagaatagagatcctaaaaaccttccagctacaaaacatctttttaaaaatataaaaaaatacaaaaataactctgaaatcaatagaagacacatggtgaaaccaaaattctagaatacagggagaataaaggcattttcagatattacaaaaacagaaaattgatcattgctgaagtaatttctaaagaatgtacttgagggagaagaaaaatgttccaaagaaaagtatctgtgatacaagaaggaatggaaagtgaagaaatggtaaacaggtagataaagctaataaatgttgacctagaaaataacaaaaacaatagcaataatgtctcgttggaagggttgaagtaaaaatacaattaaggccaaatgtgaggtaagtggaatgaaagaattagaagtccttgccttgttcacaggactgattaaataaatgagccaggttttccattcaaacagttaaaacttgaacaaaataaactcaaattaagtagaaagataaaaaacagaaattaatgtcatagaaaaataaaaaatcaatagaattaatcaataaatcctggttaataaaagctggttctttgaaaggattaataaaataatcattaagcaagtctgatcaaaaaaaaagagaaaaggtaccaaaaaaagtactgtatcagaaagagaacatacagatacatacagatatgtaagagtctgttttcttacaccagaatactatatacaacattatgctagcatatattaaatttcaataatgttaatgattttctaggaaaacagaaaatattaaatttactttgaagaaacagaaaaactgagaaaaataaatgatcatgaaaaaaatgaaaaggtaattaaatactgatattaactgcctaaacaacaccagcagcagcccaggcagtctgcagtcaagttctgccaaacttgagggaacagataattcttctattccagagcatagaaaatgatggaaagtttcccaatttaatcagagaggacagcctgatccttgttatgaacacagataaaaatggggtaaactatatgccaaactcagataccaaaaccctaaataagatgctagcttattgatgtgaacaatccaaaagtgcattttaaattagcccagggttttagagaaagaaaatctagcaatgtgaccaccacttatgttaacaattttaagacgaaaatctacatgatcatatcaatgcatgctacacaaaagcatttgggcaaaaaacccaacacccacccttgactttttaaactcttagtaattaggcataaacagaaatgtacttaatgtgatagaatacactcggtgaagatacagagggaatgctccctaaaaccaagcccaagacaaagattcctatttaacctcaatagtcaacactgcagcgagagtaatctatggaagacaaggaaaaaagtaaaaacatgagagacatctgttgtttaacagacaataagatcacctacttggaagaggcaaacgaatcaagcgaaaaactattaaaactgagacaggctttagtatggaggctcagcttcagctgtagtttgggctaccaaattcaactcgcttgcttggagagttaatcctgcaaagctaatttctgttgaggtattaggattgacaagcctgtgctcctccctcctcccccatcttcaacactgaaataacacggtgtttggaactggataacagaatcttccaaaaacaaaaattgtcctgaagggctgacttgtgcccttactcaaaaaacactttatctgctgcctgcagctcctacagttgctggtggataagcctgccaaccagctcggcgtaattcttcctgcagagggcaaggaagagcactttcacaggaaaatttttttccgaactgtatgccgcttattacataaacttacgtgctggcaaatggagctccagcaaaataagatattcagagtcaaacttccttaggaaaaaaaaaaaaaaaaagcaagcacataacactaatttccttgcatgggcactggggaaggaggtcgttacttccgcacgcccgcaggtccgcaccaccgggaaacccacgggcaccgcgcgctgcccccgggccttccaggtgcactgcgccgcggcgccccagctgacccgggatgcgcagccctagcccttcccctgtcaccccggccaggaaggggcgggagcgcggcggacgccgagggcgaagggcttctcggtcctctgcaccacgcagcacccccaaggcacaacagggagggtgcgggaggctcccgagacccaggagccggggccgggcgtgcccgcgcacctgtcccactgcggcgagggctggggtcgcctccagggccgcagctgtcgggagccacctggctctcagtcccgggtccctgcgacaaccctcgggcccggaggggaggaggcggccacctgccgctgccacctgcggcaccggtcccaccgctccgggccgggcaggacaggccaggacgtccctcctgggctggggacaggacacgcgacgaggggaccggggcccccgcggcgaagacgcagcacgccttcccagaaaggcagtcccgtgcccccacgacggactgccggacccccgcgctcgcccgcccatcccttcagaccacgcggctgaggcgcaaagagccggccggcgggcgggctggcggcgcggctagtactcaccggccccgctggctcagcgccgccgcaacccccagcggccacggctccgggcgctcactgatgctcaggagagggacccgcgctccgccggcgcctccagccatcgccgccagggggcgagcgcgagccgcgcggggctcgctgggagatgtagtacccggaccgccgcctgcgccgtcctccttcagccggcggccgggggccccctctctcccagctctcagtgtctcatctccctatctgctcatcctctggtcgcacataatcgatgtttgggcgtcccaagccagatgtggaccccatttccgcactctacactggaggttttctaagggtggtgcccggaccagcagcttcagcctcatctgggaacttgagaaaatgcagattctccgtcccacccagcctattcggtttttcctgcactaaaaccatgaaggtggggcccagcagtccacattctcgcaagcccgtcaagtgattctgaggcgccctccagtttgagagctatgctcacggcctcacctccgccccgcaaggagcccggtcttgcctgtggcgctagccgcacacggacacctcatcctgcggggcccgcccccccgctgcaccctcaccgcccaacgcctcctccgggatgcagcggaggcgcctggaagtcggcaaggtcaacatccccctcagcatcttccctaccctcacggctcctcctccaggggtgcctcatggccaggggttagaaagagccactgtgtttcttgacatggaagtggcctaagaccttaatgaaaactgcaggagtggaatgacagaacctttggtcatacttgagggcgtgaagctcaaatgaggaggaaggaaaggatccagggagaataaccaaccctggcaagttgtggcgcccaggtagaggggcgagcctaggctagcggttctcgaccagggccggtgttgcccctcctcgccgccccgcgtacatttggggaggtctggagacatttttggttgtcatgatgcgggagttgctactgttgcctaagtgggtagacacgagggtgctcctcaacatcctacctgaaggacaggactgccccacaaggaagaatgatccggccccaaataagaaaccctgggctggtcagcaacaacccctttgttctgagaagagaggaggaaagaataaaagaagtggggtgaagttttggtttggtagaggaaacttgaagacattttcactggaaaggaagagaggaagaggagggagatgtctgtaaggacgagcaaaccgggtgacagctgatttcctcatattgaagtaatgagtcctagttataataaattcctaataaaaacccagtttatccctgcaataaacttgtcttttttttttaaatatactgcttgattctgtttgctaatattttatttacaggctttgcattgatatgcaaaaatgagatgggcaataattttctttttgaatgtctaatgttgtttggtttcagaatcaatgttatgctcacatcataaaaaatttggaaccgaggcaggaggagtgcttgaggccagaagttcgagaccagtctaggaaacacagtgagacccccccatctctacaaaaaaaaaaaaagaaaaaaaaatgggcatgtttgctttttccttttactctgaacaatttaaggagcattaaaattatctattctttgaggtttgatcatttcccagttaaaaatgttcctcccagcctgatgctttctttggggagggtaaatcttttaaggctagaaaagtttcttctgtggcaattttattatttacattttaaaaattattctagagttaattttgataaagcatgtatttcttaaaacaaattatcctttttttccagatgttcaagtgtatttgcataaagttgaggaaagtagtcttttgtgaatcttttaacttctcccaaatatcttattttgtgtatttttgcttctttattttgttaacttttaaaagtgtatttttttttcaaagaatcagctcttaggtttatgtttttggttatactggagcttttttcttcttctttttaaaatattttttctcctttattttttagacgtattttgatctaacgtaatcggaagaaggtaaattagaatcttttgttactattgtgtttttatttctccttatttctctgaagtcctgctttataaatagtaccatgttatttgtgcataaatattcatttgtcttatattcttgggaattttcccacttcatcataaaatgaccttccttgtctcatttaatgtgttcaaactttgccctgaatttaactttgtctgatattttaccatcctgctgaattttgtttgttaccccaaacaacctttgctgttttcgtcttttctgaaccctttattttaggtaatcccttgaattagagcactaagttttgctttgtgattaaatctgaaaatctttatcttgccatagatgagttgagccctattcatgtgacagctatattatgctgtttcatagcccttttggtccttttttcactcttgcattgcatattttgtgtttattgtgttttgtgtttcttctgataatttggaaggtttgtatttttattcagggagttgccttataatcatactccgcaatacacatcgtcctcagtttcttcagactgtctgttaactccctattctgaataaaaatgacattgtaatttccctcttttttctttaccccttttcttctcctcacctaatgtaaatgattttatccttctttagtatttgcttttttaattaactacatttataaatatctttatcacttgatttttaaatcagctttgaatgagatatttggattcctagatataaaagatgttaattataccatttccacgttagtaggtttataaaatcatacattctgctgtgtaaccataatcccacgtttgttttagttccactcctacagttaaaagattcagaagtattattaacagttattttgccatagttttttccccaacccattttgtggtaagttatgatcctgctttagtttcttaagaataatttatagagcagagtgtggtggctcacgtttgtaatcccagcactttgggagacaagaggtagaaggatcgcttgaagccagcagttcaagaccaccctgagcaacatagtgagaccttgtctctacaaaaaattttaaaatttagccagacgtagtggcgtgtgcctatagtcccagctactcaggaggctgaggcaagaggattgctagagcccagaagtttgaggctgcagtgacctctgattgtgccactgcaccccagtctgggcaagaaagtgagaacctatctctttaaaataacaataataacttatgaaaattatattccctgagtttttcatgtttaaaaatatttgttgcctttatcctgtaaaagtttgagtataaattcttgggttatactttatttattgaagaatgtataagtattgtcttctagaattgagtgttgctgtaatgaaaccagaagtcagcctggtttatttttcctcagaaatgaggtaattgccggccggacaccgtggctcatgcctgtaatcccaacactttgggaggccgagacaggtggatcacgaggtcaggagattgagaccatcctggctaacatggtgaaaccccggctctactaaaagtacaaaaagttagctgggcatggtggtggacgcctgtaatcccagctacccgggaggctgaggcaggagaatggcgtgaacctgggaggaggagcttgcagagagctgagatcgcgccactgcactccagcctgggcgacagagtgagactccgtctcaaaaaaacaaaaaaaaaacaaagaagtgaagtaattgccatgatgctccaagaattatctctttgtctatgaaatccagaaatctcactgttatacattttggaattattattctgggccaatatttcctgggacacaatagattgactctatagatttaattttttttttttttttgagacagagtctcactgcaatctcagcttactgcaacctctgcctcacgggttcaagcaattctcctgcctcagcctcccaagtagctgggactacaggcgcgtggcaccatgcctggctaatttttgtctttttagtagagacagggtttcaccatgttggccaggctggtcttgaacgcctaacctcaagtgatccacctgcctcagcctcccaaagtgctgggattacaggcgtgagccaccatgcccagcctcaattcctctttctatctggtaatttttctgaagttgaaaacatttgttctaatacgttatttcagtgttcttctaagatgtgtaaagcaccctattcccaggtcagcccccatcttgctagtgagctcggctggttcttcacaagagctctggttttctcctgcttaatctcaagtacctctgtcagcctccacctggtttatgatttggagttttttggtttttgttttttgtttttgacagagtcttactctgtcacccaggctggagagcagtggcataatctcagctcactgcaacctctgtctcccaggtttgagcgattctcctgcctcagcctactgagtagctgggattacaggcgcgtgccaccacacccggctaatttttgtatttttagtagagatggggtttcaccatgttggccagggtggtcttgaactcctgacctcaggtaatccacctgcctcagcctcccaaagtgctgagattacaggcgtgagccaccgcgcctggcatggtttggagttttaatctgtagttttaataaagatagtgcttatgtttgtgtttcttatatttcttggtactcttgggtaatttgtaagatccccatatctacacaagaagtccattttcaattcttttcttcagactgtttattttattttattttattttatttttatgtttgagatggagtctcgctgtgtcacttctggaggctggagtgcagtggcgcgatctcaggtcactgcaacctccgtctcccgggttcaagcaattctcctgcctcagcctcccgagtagctgggattacaggcacctgccactttttaatttttttagagacagagtctcgctttgttgaccaggctggagtgcggtggtgcaatcatggctgactataacctccaaatcctgggctcaagtgatcctcctgcctcagcctcctgagtagctgggactacaggcacatgccaccatgcccagttaattttaatttttttgtagagacagggtctccatatgttgcccaggctggcctcctactcctggcctcaagtaatcctcctacctcagcctcccaaattactaggattataagcatgagccaccatgcccagccttgttctactactttaatttcatatgttaggtgaccatgtaattgatcatccaaaccaggatactgtaagaatgaaagaggctgacagtagtatgatgctgggactagcattgtgcactgagattatttctgggaaagcaggagatacggtcaccctacttatagtgtgcttgtctttggattgttgaatttggagtttctatttgcaggcttatttcaactgggcagccttgatccgccctgcccagcaatgctaccgttctctccaccgggtctctgggaccccttcagtcactatacttagctcagttccccaccctcccactccctaaaagcgtaaccaggaatcctgcctcaggtctactgccgtcttccgtgggctgtttcagttcctattacccagagtcaaactcccagcattccctacctgattccagacttggagtccagagctttaacctcttcaggccaactccccactttgcatttctgtccctatatcttagtccatggagatacatttcatgtctttgagtctacttacaaagtaaattttgctgttttttaattttttttttgagatggagtcttgccctgtcacccaggctgtggtgcaatgacgccatctcggctcactgcaacctccgcctcctgggttcaagcgattcatctgcctcagcctcccaagtagctgtgattacagacaggcaccaccacgcccagctaattttttttatcttttagtagagacagggtttcaccatgttggccaggctggtcttgaattcctgacctcgtgatctgcccatctcggcctcccaaagtgctgagattacaggcgtgagccactgtgcccagccaattttgctttttttatatttcattgctatatgtttagaggataagtttacagtgctatatgcattcccaaatattagaccaaaaaaatctccaaaaaattagaaagaaaatccaaaaaatctcaaaaaataccaaaaagcaacaatctcacagaccatactcactgacccccaataaaataaaattagaaattaaccacaacttaacaaaataaagtactcaagtcagagaggaaagaggaaataaacatcaaaattacaaagtctaggcggtggctcacgcctgtaatcccagcactttgggaggccaaggcgggcagatcacaaggtcaggaattcgagaccagcctggccaatatggtgaaaccccgtttccactaaaaatacaaaaattagccaggcatagtgatgtgtgcctgtaatccagccacttgggaggctgaggcaggagaatcactgaacccagggagacgaagattgcagtgagccaaaatcgtgccactgcacttcggcctgggtgacaaagcgagactccatctcaaaaaaaaaaaaattacaaactctttagatagaaattttggtgtttttttttgagacggagtctcactctgtcgcagaggctggagtgcagtgggactatgtcagctcaccgcaacctccatctcctggattcaagcaattctcctgtctcagcctcccaagtagctaggattacaggcgcccaccaccagacccagctagtttttatatttttagtagagatggtgtttcaccatgttggccaggctggtctcaaactcctgacctcaagtgatccacctgcttcagcctcccaaagtgctcagattacaggcgtgagccaccgcaccccacctagatagaaatttcaacatgaggccgggcacaatggctcacgcctgtaatctcagcacttcaggaggctgaggcgtgggaggatcacttgggcccaggagttcaggaccagcatgggtgacagagacagaccctgtctctatttatttgaaaaaaaaaaaaaaaaagagagagagaaagaaatttcaacatgaaaagtatctctcaaacccttcgagatgttggcaaaaagcgactcaaaggaaaatgtattactgtgtgtgaatttgcttgaaaataagaaagaggccgggtgtggtggctaacacctgtaatcccaacactctgggagtccgaatcaagtggatcatgaggtcaggagatcgagaccatcctggctaacatggtgaaaccctgtctctactaaaaatacaaaaaattagctaggcgcggtggctcatgcctgtaatcccagcactttgggaggctgaggcaggtggatcacctgaggtcaggggtttgagaccagcctggcctacatggtgaaacctcgtctcttctacaaatacaaaaattagctgggcgtggtggtgggtgcctgtaatcccagctactcagaggctgaggcaggagaatcgcttgaacccgggaggcggaggttgcggtgagccgagatcgcaccactacactccagcctgggcaacagcctgggtgacacagtgagactccatctcaaaaaatacaaaaaattagctgggtgtggtggcctgcgcctgtagtcccagctacccgggaggctgaggcaggagaatggagtgaacctgggaggaggagcttgcagtgagccgagatcccaccactgcactccagcctgggcgacagagcaagactcttgtctcaaaaaaaagaaaaaaaaaggaaaaaagaaccctgataataaagaaaccaaatgttcaactctcaaagctcggacactttaaagaaataattaataaaggcagaagttaaagggaggatgataaagcaattttttttgttggtttttttgagatggagtcttgctctgtcacccaggctggagtgcagtgatgcgatcttggctcactgcaacctctgcctcccgggttcaagcaattctcctgcctcagcctcctgagtagctggtactacaggtgcgcgccacctggcccagctaatttttgtatttttattagagacggggtttcaccatatttgttaggctggtctcaaactcctgatctcaggtaatctgcccacctcggcctctcaaagtgctgggattacaggcaggcgccaccgcgcctggcctaaagcaaaatattggttctgtgcaaaaggtcaataaaaagagcaaacgtttacaaactggagccagcacccattcagctcagtgtgtctggagaaaaaacaatctcgcttcagaattcatgattacgcagccctttttgcttcctaaaaatcctactatgttgctgttgaccattctctctctttctctctctcttgctttctctccagaaaagctattcagacattctcctctttcctcaaacctccaacacttcctcctccatccttagcctcagctgctgacctcacttctaatcattgagaaaccaggagaagcatttaagagtgaacctccgcctccccgcacgggcaaaaccacccacccacagaattgtgccccaattctgcgtcctctcctctcaccatggatggacggtccaggctccgagccaaagccaggcctcccctggagctctggatccaccacctgcagcttctcaggcagggccccagcagctcccctgctcccttgtaccatcaatccctcccctcactgggtcactcccaacaatatatatatttagtgatgtttctcccatgtggtaaaatcacttagcctctctcctcccccagctactatcctatttgtttctttccattctctgcaaaacttctcaaagcattgtgtctatgtgctgactccatttatcttctcccgttctctgctgagtccttcccacagactctcaccccagttactccatgaaatgacctctgcactgccacatccaatggtgaatgttcagttcttaattttattcagtctttcagcagcatttgacctggccgatcactccctcttcttaaaaatacttttctcagccaggcgtgatggctcacacctgtaatcccaacactttgggaggccaaggcgggaggatcatgagagcccaggagttcaagatcagcctgggcaacatggcaagaccctatctctacaaaaactaaaaagtagccagtgtgatggcatgcacctgtagtcccatctacttaggaggctgaggcagtaggatgacttgagcctgggaaatcaaggctgcagtgagccatgattgcaccactgcactccagcctgagtgacagcgagaccctgtctcaaaaagacaaaataggaaacttttctcagcatattcctctgattctcctgctgcttctgtctgcacagattcagtctcctttgccggttcttcctcatcctcctgatctcttgaccttgaagtgccccagagtacagtctttttttttttttttgagacgcagtctcgtctgtcacccaagctggagtgcaatggcgaggtctcagctcatgcaacctctgcctcctgggttcaagcgattctcctgcctcagcctcccaagtagccaggactacaggcacatgccaccatgcccagcaaattgttgtatttttagtagagacagggttttactatattggccacgctggtctcaaactcctgaactcgtgaaccacccgcctcggcctcccaaagtgctgagattacaggcatgagccaccacacccggcccagagtacagtctttagacggcctctctacctatacttgctcccctcataaactcctcctgcctcatggctttaaataccatcggtagactgatgactcccatatttctcttttttttttggagacggagtctcgctcagtcccccaggctggagtgcagtggcgcgatctcggctcactgcaagctccacctgccaagttcacaccattctcctacctcagcctctccagtagctgggactacaggcacccgccaccacgcctggctaatttttttgtatttttagtagagatggggtttcaccatgttagccaggatggtctcgatctcctgacctcgtgatccgcccatctcggcctcccaaagtgctgggattataggtgtgagccaccgtgcccagccgatgactcccatatttctatctcttgctgtgtgggagttctcctcagaactccatactcataaatccaactctcataaatagtatctcaaatgggcaatatgctcaaaagtcaattcctacttttctccctaaacttgctttcctgcagtctccaccatcttaatgtccaatctaacattaggaggcaaaaactttgaagtcattcttgactcttctctattacacaccctatccaatctttctgcagatccagtcgacccccaaatccagttagctctcatcatctcccctgttaccccctggtccaggccatcttcctctctcacctgaatcactgcagcattctcctcactggtctctttggttctgttttcactccaccttagcatagtctccacagagcagtcagagggatccttttaaagtgtaattcccatcctgtccctgctctgctcaaaaccctgtcgtgattcccgttttaatctgtcagattaaaagccagagtctttccagtgacctacatgatctgcctattatcacctcccacttctttccccttgctcactccactccagctctgcagctgtcctttctgtttcctgaacagcccagattttgcttctttagaacctttgtatttgctgtcccctctgtctggaatgtttttccaggaagtcacctggctctctcctgcacttccttcctgaccaccatgtttaaaaatcactcaaacacacttcaggccggacatggtggctcacgcctgtaatcccagcactttgggaggccaaggtgggtggatcacctgaggtcaggagttcgagaccagcctggccaacatggtgaaacttcgtctctactacaaatacaaatagtagccaggtgtagtggcacacacctgtaatctcagctactcaggaggctgaggcaggagaatcgcttgaacccagaaggcagaggaggtgcagtgagccaagatcacgccacaacaccccagcctgggtgacagagcaagaccccatctcaaaaaaaaaaaaagaaaaaaaaatcacacaaacacacttctcttcatattccttttccaagttttatttttctccagaatactttacattgttttaatggaagttctccgtttccccccaactagaatggatacttcctgcaggtaggcactctagtcctcccatccaagtactaaccaggctcaaccctgcttagcttctgagagcaggggagatcaggcctgttcagggtggtatggcccaggaattttgattctgttttattcattgctgttctgttgattctcttttgttcctcctcctagtgctgagaacactacttgtacataataagcattcaataaatatttgttgaatgaatgacttgttgaatgaattaatctcagaaatgcaggactggttctacattagaaaatttttcaaggtcattctctgttgtcgtaacacattaagagaggaaaattttgtactctaaatcatttgataaaatacatactgatttctgttttcaaaaactcttagtggctgggcgaggtggctcacatctataatcccagcattttgggaggacgaggtgggcggatcacttgaggtcaggagtttgagaccagcctggccatcatggtgaaaccctatctctactgaaaatagaaaaattagccgggtgtggtggcgcatgcctgtagtcccagctacctgggaggctgaggcaggagaatggcttgaacccgggaggcggaggttgcagtgagccaagatcatgccattgcactccagcctgggtaacagagtgagactccatctcaaaagaaaactcttagtgagtttaggaatccaaggaagaccctcaaactaaatagataatctagctaccagaagccttcagtaaaccttaacactccatggtgaaacattagaaacattcctactaaaagacaggctaagaatgcctgcaatcttcacggctagtccaagaagtcaaaaagaagaaatgagcgctgatttaaaaaaataaacaaacaaaaaactaccgatgcagaggctggcagcaaggactgaaggactgtacagtacttgcctggagcaggcggatggccacacccctgcgaagcctgctcagctggctgggggacgctccagtgtgtgagtggcaggatgcagggtacttcctctgccagggagttgcactggggagatcctcccccactcacactttggcagctggggctttggaatgtgacttagcttctgtcaaagggtcaatccaccctttgatatatgatgcaaaggcgaacatatgatgcaaaggtgagagaacagcccaaattaggacttttaccacagctgtggaggtggacagcgacagtggtgggccctggccagacttttcatgctcaaaggtggtggttgttcttcctacttcttgtccctccagggcttcctttgcctgtgtgctgaacctgcttcttttaattttttttaacttttttaaatttttaattgttttaattaaaacaaattttgaaaactgtctgaacctgcttttgaaccctgctatgatttgaatgtttgtcccctgccaaactgattttgaaacttaatctccaaagtggcaatattgagatggggctttaagcagtgactggatcatgagagctctgacctcatgagtggattaatggattaatgagttgtcatgggagtggcatcagtggctttataagaggaagaattaagacctgagctagcatggtcgccccttcaccatttgatatcttacactgcctaggggctctgcagagagtccccaccaacaagaaggctctcaccagatacagctcctcaaccttgtacttctcagcctctgtaactgtaagaaataaatgccttttctttatgaattacccagtttcagatattctgttataaacaatagaaaacgaactaaggcaaactctcatgattctactgccatgccattccaataaactccctttatgcttaagagagccagagttggccaggcgtggtgactcacgcctgtaattccagcactttgggaggccgaggcaggtggatcacaaggtcaggagatcgagaccatcctggctaacacggtgaaaccccgtctctactaaaaatacaaaaaaattagctgggcgtggtagtgggtgcctgtagtcccagctactcgggaggctgaagcaggaggagaatggcgtggacccaggaggcggagcttgcagtgagtcgagatcgtgccactgcactccagcctgggtgacagaatgagactccgtctcaaaaaaaaagagagccagagtttatttctgttgcttgcaaccaagaaatctggctggtgcactgaagtttccataaataatagcaatttaaagactctttccaagccaggcaatgcctagccttgtgtagtccttgtggtaatacattcattcattcatttgttcaaccaactgtgctccagagactaagaatacaaaaatgggggccgggtgtggtggctcacacctataatcctagcactttgggaggccgaggcaggtagatcacctgaggtcaggagttcgagaccaacctggccaaaatggtgaaacccctactctactaaaaatacaaaaaattagctgggggtggtggcggacacctgtaatcccagctactcgtgagactgaggcaggagaatcacttgaacccgggaggcagaggttgcagtgagccgagatcgcaccactgcactccagcctgggcaacaagagcgaaactccacctcgaaaaaaaaaaaaaaaaaaaaagagggccggggctgggcgcagtggctcacgcctgtaatcccagcactctgggaggccaaggcaggagaattacgaggtcagcagatcgagaccagcctgaccaacatggtgaaaccccatctctactaaaaatacaaaaattatccgggcgtggtggcgcacacctctagtcccagctacttgggaggctgaggcaggagaatcgcttgaacccgggaggcagaggttgcagtgagccgaaatcatgccactgcactccagcctgggtgacagagtgagactccgtctcaaaaaaaaaataaaaaaaaaaaaagaattcaaaaattgtagagttatagtgtgcttctagtttagttgagaggacatctgtccttcaaggaaggctagaatctataccctgagtccttactgaaatcaatccagcagtcaaaacatgggaccaacgatcacagcagtaagataggaagagcacctttgtacatttagctcatgttgagataagccactgacagagctgaaggaagctcacagttctgggttccatcctttggcatttaaaaagaaaagtgctaagaaaattcggttggtcacggtggctcacgcctgtaatcccaacactttgagaggccaaggcaggcagatcacgaggtcaggagttcgaaaccagcctggccaacatggtgaaaccccgtctctactaaaaacagaaaaattagccgggcatggtggcgcatgcctataatcccagctactcaggaggctgaggcaggagaattgcttgaacccgggagggggaggttgcagcgagtgagagcaggccactgcactccagcctgggagacagagcaagactctgtctcaaaaaaaaaaaagaaaaaaagaaagaaaggaaaaaaagaaagaaaaaaaaagaaaaaagaaaattcaggccaggccaggcctggtggctcacacctgtaatcccaacactttgggaggctgaagcgagacggtgccttagcccaggagtttgagaccagcctgagcaacatagcgagaccctgtctctataaaaaaaaatttttttttggccagacgcagtggctcacgcctgtaatcccagcactttgggaggccgaggcaggtggatcacgaggtcaggagatggagaccatcctggctaacacggtgaaaccccatctctactaaaaaatacaaaaaattaaccgggcgtggtggcgggcgcctgtagtcccagctactcgggaggctgaggcaggagaatggcgtgaacccgggaggcggagcttgcagtgagccgagattgcgccactgcactccagactgggagagagtgagactccgtctcaaaaaaaaaaaaaaaaaaaaaaaattaattgtcaggtgtgctggcatgcagctgtagtcctagctactcgggaggctgaggtaagaagatcgcttgagcccaggagttcaaggctgcagtaatagtgcctctcactctaccctgggtgacaatgagaccctctctcaaaaagaaagaaaaaagggaaagaagaaaagaaagaaagaaagagaagaaaggaaggaagaaagaaagaaaaagaaaaggaaggaaggaagaagaaaaaaaaagaaagaaagaaaagagagagaagttcaaagaccaaagggtcaggatcccaaaatagtttttatgttttatttatttatttacttatttatttttgagacagtatggctctgtcgcccaggctggagtgcagtgatgcgattgcggctcactgcagcctccaaactgggctcaggtggccctcccacctcagcctcccgagtagctgggaccacaggcgcgtgccaccatgcccagctaattttttaattctttgtagagatgaggtctctatatgctgcccaggctggtctcgagctcctgggcttaagccatccacccgcctgggcctcccaaagtgctgggattacagaagtgagccaccgcgcctaatcgggtggtttgtttgtttattgacggggtctcgctgctgcccaggctggagtgccagtggctgttcacaggtgcagtcctggagcattgcatcagctcttgggctctagcgatcctccagagtagctgcagctgggattccaggcgcgccaccgcgcggggctcagaatgggtttttatattgagggttatgctgccacctagaggatatatgtagtaccgaactgtgtgcgcagggaggctgaggttgcagtgagccaagatgatgccagggcactccagcgtgggtgacagagcaagatttcatctcaaaaaaaaaaaaaaaaaaaaaaaaaaaagaattgaaagtaaggtcttgaagagatatttgtgcctgtatggtcatagcagtattaactttgacccactagctaaaacacaaaagcaacatgtgtctgtcagcaggtgaacggataaacaaaatgtggtatatatgtacaattgaatattattcagcctttaaaaaggaataaaaggctggatgcgggggctcacgcctgtaatcctaacactttgggagactgaggtgggtggatcacccgaggttaggagtttgagaacagcctggccaacatggtgaaacttcatctctactaaaaatactaaaattagccgggcatggtggcacttgtctgtaatccaagctactggggaggctaaggcaggagaattgcttgaactcaggagccggaggttgcagtgagctaagatggcaccactgcactccagcctgggcaacagagtgagactccatctcaaaacaaacaaacaaaaaattattatttccaaagaaacaagaccctgggtccatttcccagcccacacctgatgttgactcacaacacacagcctggtttgctatgagcctgcttcatttaattgtcaccttaacttcacatcaccctcaagtcctggaataactctttgctgacctttgtgtgctgagccatctccatgtcgctcaacgtgcagtccctctcactgcactgagtcaatagccagacgtggtctgactgcagggtcatccttggtggcttaggctgactcgggcatagcagggtgctctgagacctcaccgcatataggctttgcccccaataaactctatataatattcatattatgtggtctgggtgtgtgtagctttgcactgtcttctcgtgacagtgccctcaacctctttcccaggatttcctcctctacctcctcaagtcccactgctctgcaaagaccaaaagctgcagagtcccagctccctcctttacaccccacgacgcagcctcctctctcagaaccctttaaacagagtcttttactgcagatcccaagaacagccacacccctctctcccacccactccagacacacccaggtaattatagcacccagggtaactatgtagatggagtccctggaacatgtggatagtgccccctgggagtatgcaaaagcaacattgctggcacctgcagagaacagggtgacatccaggaatcagagcatgggcctctgggaggtagggatgtggccaggcaggctgccaaaaattggtagagcaaggccacaggatctttctgaccttccttccaaacagaggctcctgtactggtgatccctgtgttgattgaccactcccttcctgggggtcgtggtctctgtcccagttgcccggacttctgtgagtgtcctactgaggtccttttcatgagaagcatgctgtccttccacctgctgggagcaagagtgacaacttcaatactataatagcagtggcatacagagaagaagaaagatgaagtggcaagaaaaacaggcttccaagcaggagtttttctataaaaacaaaaacgtttacaagcaaactttttataaagggctagatagtaaatattttaggctttgagagccacatagacttgtttgcagggactcaatgtcgctattgtagtttgaaagcagccatcagggttatgtaaatgagtgagtctgattttgtttcagcaaaattttatttaccaaaacagacaatgagtgggctggatttggcccatgatccttagtttgccaactcctgctttgggctcacccagatctgattttgaattctggctctgctactggttagctgcaggagcttggaaggctctctgagcctgtttcctcatctgtaaaattaaagcaataatttctaacactcaagagtgttacctcacgcctgtaatcccagcactttggaggctgaggcaggcggatcacctgaggtcagaagttcaagaccagcgtggccaacgtggcaaaaccctgtctctactaaaaaatacaaaaagtagccgggcatggtggcgcgcatctgtaatcccagctacttgggaggctgaggcagggatactgctagaacctgggaggtggagcgtgcagtgagtggagatcacacctccacactccagcctggccgacagagcgagactccatctcaaaaaaaaaaaaaaaaagagtgttagaaggttttgagataatgaataaaagatgccttgtgtatactaagtattcaacaactgatagctgcattggtctaattataacagtttagaagcgattgagtcaacaaatgctggatttgtcagggaggacttcctatcaggaggtagatcttgggctgagtcctgaagcaaagataggcattggatagaggagttgagagaacaccctaggactgttattattattattcgacacggagtctcttgctctgtcacccaggctggagtgcagtggcgcgatctcggctcactgcaacctctgcctcccaggttcaagcgattctcctgcctcctaagtagctgagactacaggtgtgtgccaccacacccggctaatttttatatttttagtagagacagagtttcaccatgttggccatgctggtctcgaactcctgacttcaggtgatccacccgcctcagcctcccaaagtgctggaataacagatgtgagccaccgcacccagcccagaaccatttttcaatccttggctctgccttttattagctgcaagatctcaggcaatttatttaacctctccaaagactcattttctcattcacaaaatgaggcaaataataatatctactatcccaggttgtcatgagaattaaatgcaacatgacatttaatgaaatgagaagtcccttggacattaactggctaaagtatgtgctcgacaaggatatcattttaggtggatacttagcatctcagaactgatgctcacaatggaatatcattgaaacgcattaaaattcattttaaatgattgtaggtagtgaggcaattgaaagaagaagacaagaggactgattataatgcttcaggctcactagtctccttttaggagggaaaaacaatttcaagttaaattttaggctctagatttttacccctgctgctcattagaatcacccagattgatgaaatcagagcccatctgaggctgtgtttttcatctccagaatgagagctgttgtggggattaagtttttgaaaaagtacatctaacaggtgatcgaaaatgatagtgatattattgcagtgatggtcattattgttgttattattatactgaaagaggcttcagttttctgatccataaagtgagggaattgcatgagaccattgctaagattccttctagctctgtttttttgtttttgttttttagacagagtctctgtcgcccaggctggagtgcaatggcatgatcttggctcactgcaacctccgcctcccgggttcaaatgatcctcctgtctcagcctccgaagtagctgggactacaggcacacaccaccatgcccagctaacttttatatttttaatagaggtggggtttcaccatattggtcaggctggtctcaaactcctgacctcaggtgatccacccgcctcggcctcccaacatgctgggattacaggcatgagccactgtgcccaaccccttctagctttcttgatcactgattctagggttctctgctgaaatatatttgagacatcctggataaaagatcatgcaagagctcccaatatggtattaataattgattctggaggcttagctactcctgatggattagacatgactcaactgcctctcttatgtgtacaacacaacaacacaaccaagaaaggttattctggcattccatttattcagtttatttacagcccttacttccagcagcacgttaaagatatggccagggccgggtgcagtggctcaagtctgtaatcccaggactttgggaggccaaggtgggcggatcacaaggtcaggagtttgagaatctggcaattcttcagacttagaagcaaccagctcgataacacagtcttgtgtgggctctccctctgtccctccctcgcttccctcatttctcatccctgcccctgagactgtgcaccttcacatagccctgccatgagaccttcatctcaggctttgctttctggggtaactgaggctaaacactgagtggccctaaaagaggattgggatttggaagttagattattcaccagagaacagactttgctgatgatcaggcccaggttgtaattgttgaaaaaaagagaggatgcatagtcttatctcatctcctagtcaaagtcaacaccatgataaataagagtcaaatcctgagatgtgaattggggacatttgagtggttaaccctgagaagcttgcaccttcagacccctcaatacccctgctccccagagaaggctggacattgacctcagcacaggcaggagccctgcaagatgccatttgtcctactaaagatggacccctccactctgtttctaggtaaataaccaaagtcaagtctccacacagcctgagcaagaaagtcagagcctgctacaggagaaaataccacactggccaaaggattcactagccctggccactgtgtgtgggaggaaccagggaatcatgtgtgggagtcaatgttgaagctgttggactgggggtggggtggaatataagcctggccctggggagtttttcccgtttgagggcctttacccacaactcaagatccagtgctatagcaggagatcccagagctagtcctaacagatggtcaggattgaacttggcctagagtaaaatgaggaggatagtgccagaactttctcaacatactattgaggaagaggtcagaaggcttaaggaggtagtgtaactggaaaggggtcctgatccagaccccaggagagggttcttggaccttgcataagaaagagttcgagacgagtccacccagtaaagtgaaagcaattttattaaagaagaaacagaaaaatggctactccatagagcagcgacatgggctgcttaactgagtgttcttatgattatttcttgattctatgctaaacaaagggtggattatttgtgaggtttccaggaaaggggcagggatttcccagaactgatggatccccccacttttagaccatatagagtaacttcctgacgttgccatggcgtttgtaaactgtcatggccctggagggaatgtcttttagcatgttaatgtattataatgtgtataatgagcagtgaggacggccagaggtcgctttcatcaccatcttggttttggtgggttttggccggcttctttatcacatcctgttttatgagcagggtctttatgacctataacttctcctgccgacctcctatctcctcctgtgactaagaatgcagcctagcaggtctcagcctcattttaccatggagtcgctctgattccaatgcctctgacagcaggaatgttggaattgaattactatgcaagacctgagaagccattggaggacacagccttcattaggacactggcatctgtgacaggctgggtggtggtaattgtctgttggccagtgtggactgtgggagatgctactactgtaagatatgacaaggtttctcttcaaacaggctgatccgcttcttattctctaattccaagtaccaccccccgcctttcttctccttttccttctttctgattttactacatgcccaggcatgctacggccccagctcacattcctttccttatttaaaaatggactggggctgggcgcggtggctcatgcctgtaatcccagcactttgggaggccgaggcgggcggatcatgaggtcaggagatcgagaccatcctggctaacacggtgaaaccccgtctctactaaaaatgcaaaaacattagccaggcgtggttgcaggtgcctgcagtcccagcggctcaggaggctgaggcaggagaatggcgtgaacctgggaggtggaggttgcaatgagccgagattgtgccactgcactccagcctgggtgacagagcgagactccgtctcaaaaaaaaaaaaaaaaaaaaaaatagctgggcatggtggcgcgtgcctgtaataccagctactctggaggctgaggcaagagaatcgcttgaacccagtaggcggaagttgcagtgagccgagatcttgacactgcactccagcctggtgacagagtgagactctgtctcaaaaaaaaaaaaaagaaaaaaaaagacagaaagaaagagcacagacagagtcacaggtatttgcagtaggaagctgtcaggttagagtgcacggaaatagaaagtatattttacacttacagcacatcttcgtttgattagccacatttaaaatactgaatagcaacgtgtggctatttagtattcactaaaatcttggacagtgcaagtctaaagaatccttgatccgtccggcatggtggctcacgcctttaatcccagcactttgggaggccaaggtggaaggatcacttaaggtcaggagttcgagaccagcctggccaacatggtgaaacctcgtctctactaataatacaaaaaaaattagccgggcatggtggtgcatgcctgtaatcccaggtacttgggaggctgaggcaggagaatagcttgaatccaggaggcgctgcagtgagccgagatcatgccatgccactactgcactccagcctgggcaacagagtgagactgtctcaaaaaaaaaaaaaaaattgttgggcgtggtggctcacgcctgtaatcccagcactttgggaggctgaggggggtggatcacctgggttctggagttcgagaccagcctggccaacatggtgaaaccccatctctactaaaaatacaaaaattagctgggcgtggtggtgggcacctgaaatctcagctactcaggaggctgaggcaggagaatttcttgaacccaggaggcagaggttgcagtgagccaagatcgcgcctctgcactccatcctgggtggcagagcaagactatgtctcaaaaaaaaaaaaaaaaatacttgattgtctggacattctgcagaacatcatatggagacactatgttgacgacatcatgctgattgtaagcaagaaatggcaagtgttccagaaacacagtcaagacacatacatgccagaaggtgagatataaactctactaagattcagtggcctgccacactggtgacatttttaaacctgctagatgtttgtgtagaaaaggatttaaccttgcccaaagaggggtctggcctttgtccccagctactggacataatctctttaaactcttgaaatatcattcctgatagaagtatttttgttttgactaggggccttgggccagccagatagcaacaatgtgatctgggttgggggctttggatcaggtggcatcagtgtgacctcctgagtggctagagactagaatcaaccacatgggcagacaacccagcttacatgatggaattccaataaagactttggacacaagggcttgggtaagctttcctggttggcaatgctctatactgggaaacccattctgactccatagggagaggacaactggatattctcatttggtacctccctgggctttgccctatgcatttttcccttgtctgattattattattattatgagatggaatctcgctctgtcacccaggctggagtgcagtggaatgatctcaactcactgcaacctctgcctccccggttcaagcgattttcctgtctcggcctcccgagtagctgggactacagatgcataccaccacacccggctaatttttttgtatttttagtagagacggggtttcacgttagccaggatggtctcgatctcctgacctcatgttccgcctgcctcggcctctcaaagtgctaggaatacatgtgtgagccaccgcgcccagcccccttggctgattattaaagtgtatccttgagctgtagtaaattataaccgtgaatataacagcttttagtgagttttgtgagcacttctagcaaattatcaaacctaaggatagccttggggacccctgaacttgcagttggtgtcagaaataagggtgctcatgtgtgtaccatgccctctaattttgtagttaattaactttcacaactttattattaccgcttacactcaatgtttattcacatttatccacataccacttattctagtgccttgcatcaaagactttctatctcatgtactttattctgcttgaagtaaatcctttaggatattcttttttttttttaaactttgcacatacatacttttattttttatttatttttaattttgttatttttgtgggtacgtagtagatatatgtatttatggagtacatgagatgttttgatacaggcatgcaatgtgaaataagcacatcatggagaatggggtatccatcctctcaagcaatttatccttcaagttacaaacaatccaattacactctttaagttattttaaaatgtacatttaattttgtattgactagagtcactctgttgtgctatcaaatataattttttttttttttgagacagagtctcactcagtggcccagactgaaagtgcagtggcacaagctcggctcacttcaatctctgcctccctggttcaagcgaatctcctgcctcagcctcccacatagctgggattacaggcacacaccaccatgcccagctaatttttatatttttttagtagagacgggttttcgccatgttggccaggctggtcttgaactcctggcctcaaatgatctgaccacctcagcctcccaaagtgctaggattacaggcatgagccaccacacctggccaaaatagaatattctttagtgaggtctgctggtgacaatttttttcttttttttgagactgagtctcgctgttgtcagcttgggctggagtgcaatagcacgatctcagctcactgcaacctccacctcccggattccagcaattctcctgcctcagcctcccaagtagctgagagattacaggcacccaccaccacacgcggctaatttttgtatttttagtagaaatgggggttcaccgtgttggccaggctggtctcgaactcctgacctcaggtgatccacccaccttggcctcccaaagtgctgggattacaagcatgagccaccacgcacagccaattttttccgtttttgtctgaaatcttattttgtgtcatctttgaaatatatttttgatggatataaaattgttggttgatagttattatcattattattattattttgagacagggtctcactctgttgcctatgctggggtgtagtaatgtgatctcggttcactgcagacttgacctcctagggctcaggtgatcttcccacctcagcctccctagtagctgggactacagatgcatgccaccatacccaactaatttttctattttttgtagagatgaggctttgccacatttcccaggctggtctctaactcctgagctctagcaatccacccaccttggccttacaaagtgctgggccatgactagccagcagttactttttatagcatattgaatatttaatatgaatcttctggcatccactgtaactgtttaaaaaatcagctgtttacttggcactcttttttttttttttttttttgagacagagtcttgccctgtcgcccaggctggagtgcagtggcgtgatcttggctcactgcaagctctgcctcccgggttcacgccattctcctgcctcagcctccggagtagctgggactaaaggcgcccgccaccacgcccggctgatttttttgtatttttcgtagagttggggtttcaccgtgttagccaggatggtctcgatctcctgacctcgtgatctgtccgcctcggcctcccaaagtgctgggattataggcgtgagccaccgcgcccagcctcttttttttttttttttagacggagtcttactctgtcatctaggctggtgtacagtggcgtgatctcagctcagtgcaacctccacctcctgcctcagcctgccaaatagctgggattacaggtgcgtaccatcacgcccggctaatttttgtattttcagtagagatggggtttcaccatgttagacaggctggtctcgaactcctggcctcaagtgatctgcctgccccagcctcccaaagattacaggcatgagccaccgcacccggccaagtagcactcctttgaaggtaatctgcttcccctacccctagcaatttttaacaatttttcttcatttttatttcctgaagttttgttattaataatctgtgtgcagatttctttgtatttcttttgtttgcagttcatagtgattcttgaattagtgtgttggtttctgttatcaccacaggaaaattgtcagccgttagcttttcaaatatttccttgctaaattctctcttctcccctttcggtacaattgatttgattaaaactaaaaccagggccgggtgcagtgactcatgcctgtaatcccaacactttgagaggctgaggcaggtggatcacctaagctcaggagttcaagaccagcctggccaatatggtgaaaccccgtctctactaaaaatacaaaaattaccaggcatggtggcacacatttgtagtcaggaggctgaggcaggagaattgcttgaatccaggaggtggaggttgcagtgagctgagatcccaccactgcagtctggcctgggcgacagagtgagatgagaatctgtctcgaaaaaaaaagttatgaatgtttgataaactatatttgttagaatgtttgttgtagaatactattcattgatttttaaacaatgttagattaaaccattcactggatttgtgataattaacttactgattttacctcactgatttgttgtaattaatacaactggtataaaaagactgtgacgaggccgggcatggtggctcccgcctataatcccagcactttgggaggctgaggcaggcggatcacctgaggtcaggagttcaagaccagcctgaccaacatggtgaaaccccatctttactaaaaatacaaaattagccggtcgtggtggtgcatgcctgtaatcccagctcttcgggaggctgtggcaggagaatcacttgaacccgggaggtggaggttgcagtgagccgatatcgcgccattgcactccagcctgggcaacaagagcgaaactccgtctaaaaaaaaaaaagaaaaaaaacacataaaacaaaacaacactgtgacggttcccaaaaattaggagcataattaaaggaactcctgataaaaattaattttatcttacatgtaaactaaaatgactttatgaagttaattcagaaatacaatgcagggtattagtttgccacagctgcgtattcagcctaatgtaatattcttgttatttttaaattcttcttttaactttactcatatgtggatcatcaaatttcaaaagattaaatgacaatactcttagcagcaagcttccctaagcatataaacattttaatgggtgatgattcagaaggtacccgaagaatatgtactgccagatatcattcacccccatatacctgcccgacagacatcccattttgggaccctggataaatgtgtgggtggagagaaagataggagaaagtggtataagcaaatggctttggagtctgattgacagcgattgaaatcctgtctctacctcttaacagcctcatgatcctacataagttaccccgatcctcagggccacatctgtaaattgggggttgcgatggcagccatctcacagggtctcttttcggggaagggcaggaattatggattaagtgagctagtaattgtaaagcacttaatacaaggagggcgcataataagtacttcataaataatgacggccattatcatgactgaggtgtatgcagctgtcggggattacggcgacttcagaatttctggtgggcagggctcaaaggcagcaaatcacactggaagtcgaggtgaggcactgcttctgcacagactgcttagctggagagaatgaggaaggcttagaggagatttagaggaacttagagtcctccgcctccaactctgtgggatctgctcccgtgccagagacattcaggggatttctcgcactctcccctcccctacgtccctcccgccccatccaactaaccacacaacacatacaaaatagcccctgcgaggttctgcacgctggaagggaacaggagaagggcgctgcgctttcttgctgatgccctgtacttgggcccctggtagacacagccacttgtcccctcagcctgcagagaaatcccacgtagaccgcgcccgggtccttggcttcagccaatctccctttggtgggggtgggatgcacgatccaaggttttattggctacagacagcggggtgtggtccgccaagaacacagattggctcccgagggcatctcggatccctggtggggcgccgctcagcctcccggtgcaggcccggccgaggccaggaggaagcggccagaccgcgtccattcggcgccagctcactccggacgtccggagcctctgccagcgctgcttccgtccagtgcgcctggacgcgctgtccttaactggagaaaggcttcaccttgaaatccaggcttcatccctagttagcgtgtgaccttgagcagttgactttatttttcagtgcctagttttccagataccaggactgactccaaggactattactcatctggagggtttagcacagtaccgtcgcatagtaaatttccatgtcagttttggttacctttcatgcacttgcaaacatgccatgctctgaaacgaaataggcacatcttttttttttttttttttaaggagtcttcctctcgcccaggctggagtgcagtggcgcgatcttggctcactgcaacctccacctcccgtgttcgagattctcctgcctcagcctcctgattagctgggactacaggcatgccacgacgcccagttaatttttgtatttttagtagagacggggtttcgccatcttggccaggctggtctaactcctgacctcaggtgatctgactgcctcagcctctcaaagtgttgggattacaggcataagccactgcatctggccagaaatgaaataagtaaatcttttaacctgctctaacaatatagtgaaaagaccatattattattagagcaggttaagggatttgcctatttcgggttctagttatagtcttaaacttggacattcttgtagaaagtaaaaagtttcctcttcaaagttccccttcttgttaaagaatacatcataagtgttagaagtaatagtttattttaaagactaactttcttcaagcctccttgctttgtgctaataactctttgttaagccctatcctatgtaactgttggacatgctcacaggcacgttccagttcacagcctatgccccttccttatttggaaatgttattgcttccttaaacctttcggtaagcaacttcctctccttcttcgttcttccttgcacttacctatttagaaagttttaggctattagcaaatcggctatcagtttaagagtgtgaggtcccgctccagccaatggatgcaggacatagcagtgaggacgacccaaatgcgtaagggataaatatgtttgcttttcctttgttcaggtgtgctctcgacatcgttccatctgcgattgagcaccctttctgcagaaagtaaagattgccttgctggagatcttttgtctccgtgctgacttttcttcgtggcaccgattatctatttctaacaattttggtatttctaacattctgaacaatcttgggctagttgtctcttctgggcctgtttccccatccgtcacatgataaacttcattggtttaaaaaccccagcgaacatttattgagttactattaccttcctgccctccccaaccccaaccccagggagcagttacaacctcagccgctgagcgcactcgccgggtgttaagaagcaccaaagacagggaggcttgattgattttgctttgggagtagagggtcagaagattcacaggaaaatggcatttgagcaaggatgattcactggagctagcttttaaatactggcgaggcttttatgttgcagtcccttacaaagttgagcattcgcagggactgcactccgaaataagcccgcttccccttttcattcgctaatgatccagggagctgctggttccgcatgcggcaggttgtgccttttcctaatcagggttctgcatcgcctcgaacccgcaggccgtggcgggttctcctgaggaagcagggactggggtgcagggtgaagctgctcgtgccggccagcgcctgtgagcaaaactcaaacggaggagcaggaggggtcgagctggagcgtggcagggttgaccctgccttttagaagggcacaatttgaagggtacccaggggccggaagccggggacctaaggcccgccccgttccagctgctgggagggctcccgccccagggagttagttttgcagagactgggtctgcagcgctccaccgggggccggcgacagacgccacaaaacagctgcaggaacggtggctcgctccaggcacccagggcccgggaaagaggcgcgggtagcacgcgcgggtcacgtgggcgatgcgggcgtgcgcccctgcacccgcgggagggggatggggaaaaggggcggggccggcgcttgacctcccgtgaagcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaaggtagctgagggggcgccggcggggagtcaggccgggcctcaggggcggcggtggggcaggtgggcctgcgagggctttccccaaggcggcagcaaggccttcagcgagcctcgacctcggcgcagatgccccctgagtgccttgctctgctccgggactcttctgggagggagaaggtggccttcttgcgcgaggtcagaggagtattgtcgcgctggttcagaagcgattgctaaagcccatagaagttcctgcctgtttggttaagaacagttcttaggtgggggttagtttttttgtgtttctttgaggaccgtggatcaagatcaaggaaatctctttagaaccttattatggaagtctgaagtttccaaatgttgagggttttatgtctaaaagcaacacgtgaaaaaattgttttcttcacccagtgctgtcttccaatttcctctttggggggaggggtagttactgctgttactaaaataaaattacttattgctaaagttccccaacaggaagaccactacttttgatgactttggcaagtttgctaactactggaaccctaacttacaaacgaactacttacatttttgatttccagttgtattacctgcccaatgtttacgtagaaacagcttaattttgattctgggtaacgttgttgcacttcattaaaaatacatatccgaagtgagcaagtatgggtctgtggacagcagtgatttttcctgtcaattcctgttgcttcagataaaatgtaccagacagaggccgggcgcggtggctcacgcctgtaatcccagcactttgggaggcttggcgggtggatcacctgagatcgggagttcaagaccagcctgaccaacatggagaaaccccgtgtctactaaaaatacaaaattagccagggtggtggcgcatgcctgtaatgccagctacttgggaggctgaagcaggagaatcgcttgaacctgggaggcggaggttgcggtgagccgagatagcaccattgcactccagcctgggcaaaaagagcgaaactccgtctcaaaaaaaaagtaccagacagaaatgggttttgttttctttttttgttttgagacggagtttcgctcttgttgcccaggctcgagtgcaatggcgcgatctcagtctcggctcactgcaacctctgtctcccaggtttaatcgattctcctgcctcagcctcccaagtagctgggattacccatgccccaccatgcccggctaatttttgtatttttagtagaaacggggcttcaccatgttaggctggtcttgaacccctgacctcaagtgggcctcccacctcggcctcccaaagtgccaggattacaggcatgagccaccgcggccagccagaaatgggttttggaaaaagcactaaacaaaatcgaacttggtttcatatgacagctctgctgctaactgtaacaggggcagaccagttaacctacttttctgtcttctgtcagctgagaattagatgattcccaaaggcccattgaactctgaatgactttaaatacttcttcttaagtgggtacacggttttggtaactgatgccaggtgatgaatgcatgaaagtgcttaatgaatgaaaccggtaaaatagtaggaggaagctttattggtaaggcaggggtatacctaatagctctctaatttattggtattgaagtggttaacttttgtttttttaaggggggaaaacattctaagaataatgaggcaaactgcatattgcacaagagactgttgtctctattcaacaaataccttttgagtgtccagagtctgccaggtgctgtgctaggccctcacgattgagtagtgaaccagagaatgtccctgcacccatggagcttattgtctactggggtagacagataataaataagcaaacaaatcttctctcttctccctttcgctccatgtaagtgtgtgtgtataggtgtatacttacaagttgagtaaagtgttatgaaagattaagaggagaaatgcattttggttagatgttagaggactcagcaggtgaccttgaaacttagagctgaaggatcagtaggaggtaactagagaggccagggaatcgcatgttcaaaggccaggaggcaagaaagagcatggtgcccttcaagagaggaaagaaggctactgtgactggagcatagatgtaggcaagtgttgggtgattgagagctctacgggccatggttaggttttattcctaatgccgagatgccaaacatggtggttcatatctgtaatcccagtattttaggaggccgaggcaggaatatagcttgaacccaggagttcaagaccagcctgagcaacatgagacctgtacaaaacatttaaaaaattgctgggtatgatggtgcacacctgtggtcccagctactcaggaggctgaggcagaaggatcacttgagcctaggaggtggaggctacaatgagccatatttgagtcactacactccagcctggatgacaaagtgagaccatgtgtcaaacaaaatacagaaagaatattaatttaaaattttgaaagaggagtgatctgaacttatatcttaaaaagatcattctagggcatggtggctcatgcctgtaatcaagggctttgggaggctgagacaggaggatcacctgaggccagttcgagatcaacctgtacagcatagagagactccatctctacaaaaagaaaaaataaatagctgggtgttgtgagttattcaggaggctgaagcagaaagatcacttgagcccaggagtttgaggctgcagtaagctatgatcccaccactgcaacacagtgagatcttgtctcaaaaaaaaaaaaaaatcattctaggtgctttttggaggctggatgtggtaagagtagaagctggagatggtcctgttagggattcgattcagactttaaataccatcaatgcattgagtcccaaatttacatcactacgttggatccttgcccctgaatccagactggtatatccaactttaggttcagtttgtatctctacctgaccaatatagaggtgtccagtcttttggcttccctaggccacattggaagaagaattgtcttgagccacacatagagtacactaacgctaacaatagcagatgagctaaaaaaaaatcgcaaaacttataatgttttaagaaagtttacgaatttgtgttgggcacattcagagccatcctgggccgcgggatggacaagcttaatccagtagataccttcaacttacaatatctaaaattttatgccagatttagtcattttaaacctgctcatcagtttttctcaagaagtagtattttggctttttttcttttcttttttttgagatggagtttcgctcttatcgttcaagctggagtgcagtggcggatcttggctcactgcaacctccgcctcctgggttcaagtgattctcctgcctcagcctcgcaagtagctggaattacaggcatgcgccaccatgaccagctaatttttggagacagggtttcaccatgttggtcaggctggttttgtactcctgacctcaggtgatctgcctgcctcggcctcccaaaggctgggattacaggcatgagccaccgctcccggctgcatttttggatttttagttgctcagcccaaaactttagtacatctttgaacctcttctttcctcctactctatatctgatccatcagcaaatctgttaggtctacctcacacatatcgaaatcctaccacgtctcaccatctgtgacaattaacaccctggtctaggcagtcatctctgttaagattgagtggttaaggatgtcctctaaggagatgacattcaaatcttagcttaaatgtcaagagggagctggttttataaagattgaggaggcagcattattttgccataggcttccatttggtttccattccattcttgatacttatggtatatattcaaaacaaatgcacagaaacagacccaggtatattgggaatttcggatatagagttcctagttgggaaaagatagactgatctgtaaatgatgctagttatccatcatctggcaaaaaataatttcctgcctcctctcatatatctcagatcaacagactttttctgttaagggccaaatcataaatattttaggctttccagaccatatggtttctgtcacactctcctttatccttgaagccatagacaatatgtaaacaaatgggcatggctgtgctacgataaaactttacttacaaaaactggtagtgggccagtttaggcatggccagcactttgggaggctaaggcagatggatcacttggggtcaggagtttgagaccagcctggccaacatggtgaaaccctgtctctactaaaaatacaaaaaatagctgggcatggtggtgggtgtctataattccagctactctggaggctaagacacaagaatcacttgaacccaggaggcagaggttgcagtgagctgagatagcaccactgcactccagccagggtgacggagtcttaaagcaaaacaaaacaaaaggtagtgggttgtatttggcccatgggctgtagtttgccaatccctgatgcagaaacaaattccaggtaaataagagcctggaatgttaaaaaaacaaaacttgaagtcatgtagaagaacaggtagggggaacaatcctgatctcaggataggaagggatattgcttaaaataagacacaggaaaatataatccatgttgtgtaaatttgactacgttaaaacttaaaactttcgccaagcgcggtggctcacgcctgtaataccagtactttgggaggccgaggtgagcagatcaccaggtcaggagattgagaccatcctggctaacacggtgaaaccccgtctctactaaaaatacaaaacattagccgggcgtggtggcgggcgcctgtagtcccagctacttgggaggctgaggcaggagaatggcctgaacccgggaggcgaagcttgcagtgagctgagatcgcgccactgcactccagcctgggcgacagagtgagattccgtctcaaaaaaacaaaacaaaacaaagcaaaaaacctaaaactttcatacaataaagtatacctaagatacttctagaagagaagatttacatccaggacgtgtatggaatttctgcaagtaataagtaaaagacaagggacatgaagaggcagttcacaaaagaggaagccaaaatgaccaataaacatgaaaggatgtttaacctcaaaggaaacaaggaaatgaattaaaaacatcaaatgccatttcaaaactagtaagttggcaaaattaaaaataccaaggatgagaatatgaagcatggctatatgagtgcatggaatggtacagtcactttcattaaaaatgcacataatttgttttttatttatttttttgagacagtctatgtcgcccaggctagaatgcagtggcatgatctcggctcaccacaatctctgcctcctgggttcaagcaattctcctgcctcagcctcctgagtagctgggattacaggcacatgccacaacgcccggttaagttttgtatttttagtagagacagggttttgccatgttggccaggctggtctcgaactcctgacctcaggtgagctgcttcccaaagtgctgggattagaggcgtgagccaatgctcctggctgaaaaaaatgcacataatttgttacctagcaattccatgtctagaggcttatcctagagaaattcttgcttatatgcataggaagacgtgtactagaatgttcactagttgaatgtttaagtgaaaattaggaaataaagtaaatgttcattaacaggaaaatgagtaaaggtatatttataaaacaattaagtagctaaaatgaataaactagagctgcgtgaatgaactagaactggttcaatagtcatgtcagattattgaatgaatacaggtcagatatgtatagagtgtcatttgtgtaattaattttttttttttttttgagatggagtctcactctgttgcccaggctggagtgcagtggcgtgatctcagctcactgcaacctccacctcctgggttaaagtgattctcctgcctcagcctcccgagtagttgggattacaggcatgcaccaccatgcccagctcattttcctatttttagtggccacagggtttcaccatgttggccaggctggtcttgaactcctgacctcaagtgttccacccaacttggcctcccaaagtgctaggattacaggcgtgagccaccgtgctcagccatttgcgtgatttttaaagatgtgcagaataatgccattaaaaaaaatacacatacatgtatatatatacacgtttggctgggtgtggtggctcacacctgtaatcccagcactttgggaggctgaggcaggaggatcacttgagcccaggtgtacaagactagcctgggcgagatagcaagaccccatctcaacaacagaaaggataattaggtatggtggcatgagaggatcacttgagcccaggagttcgagtgttatcaggccactgcactctagcctggacaacaaagcaagaccgtgtctcaaaaaaataaaaataaaaagtatttgtatgtggtcatagtcaaaaaacgtacatggaaggaaaatgtctttatttatttatttatttttttttttttaagacagagtcttgctctgtcacccaggctggggtacagtggtgtaatctcagctcaccgcaatctcggcctcccgggttcaagcgattcttctgcctcagccttctaagtagctgggactacaggtacccgccaccacaccctgctaattcttgtgttttcagtagagacagggtttcaccatgttggcaaggctggtctcgaactcctgaccttaagtgagccacccgccttggcctcccaaagtcctgggattacaggtgtgagccactgcgcttggccaggaaatatctaatttagtaagtatttatatctgggaaaggaagggtcaggtggtgattcataggaactctaaagtctatgtataatacttagggggacagaaggaaataaagcaaaatgctgatatttgattgttgagttgtgtatatgttagaagtataacataggagatctgattgatagtaggagaatgtttttaggtggtaaaagtggaaccgtggtggtttgttttggcagtagaatcagttggtcatagtttgtatgtggaaggtaataaacagaccatgttaaggatgacttccggaattttggtctgagtagtgggtggatgacagtgtcattcatgagggaagatgaagactgaggtaggaacaggtttgggagaagatgacatgttcccttttagacaagtggaattatggaagatggcaggtaggtggttagctatatgaatttgagataaaagatttaggatggagatataaatttaggagtaacagcgtatctatggtattgtaagccttaagaatgggtaggatcagccaggaaatacagatgtatatgcagaagagaggagtcaaggaagccaagacaagttaatgtttaaagtgagtgatgtagtccatgggcagatgctgctgagagggctgcaaacaccagtgaccctacaacatttttaaatgtcgtcttcctgacagcagtgatcagtacctgcaacgatcttatttatttttttcatgttagtctccacacacttgaatgtagactttttgaaggcaaaatcattgccttttctgagctgggagcatgtctggcacataccaagcactcaacagttgatgtattgacttcatccagatactctgagggcgagttatttcctgctactagcctttcacctttcaatgtttaagagcacaaatacagagatgggcacgttttggcatttcttattttgataaccttttcctggtaagattttttaatgttgaaaaaaaaaaacaagaaaagagggttaaaaatagtcttatgtcagatcctgtgatagaattcacacttggcttaagctgctgggcaccttcctatcttggatgtcatattagcttatctacagcagaatttttactgttttatgtagtaaggaagcaattatatgattattttacagacaaattattctttatcttttatttttttagacggagtctctctttgtctcccaggctggagtacagtgtcgcgatctcggctcactgcaacctccgcctcctgggttcaagcaattctctgcctcagcctcccaagtagctgggcttacaggtgtccgccaccacacccagctcattgttttgtatttttagtagagatggggtttcaccatgttggccaggctggtcttgagctactgacctcaggtgatccacccgccttggcatcccaaagtgctggaattacaggcgtgagccaccgtgcctggcccagacaaattattatactctgagtgttagaggcttaggatgttttcacttgatgctatgggaggaataagtaataagatatgatacacaaccaaagacctttcttcactatgcttctagtagctagtactatggatgacacatggtaataatattggttagcatttgtcctcaatttactgtgctagttactcttctaagccccttacaggtatatattttttttcatcaataatcctctaaggtagtttttattattgacctaattttataaatcaagaaaattaagacccagagaagtaagtaacttgtccaagatcacatggcttataagtggtagagccagaatttgaccccagatgttgtgactacattgtctctccataagcaggttcaactcttttgactggatgctgttccaaggtcacttccttagagaagcctttgctgacaactaccctcctgtgccctcctccaaggctgtccattgttctagaactttgaatactcatcttagaataaagctggtctaatttttacagtgttatagaatggatctctgactgcaaaagttggtcataattatctttttatgttctagtgaaaggcaaagaacaagagaagacctcagatgtgaagtccattaaaggtaagttctgcccttggcagtccactgcattaaaaagtgatgtgctttgcatttgtgagttctttaatcctgttatactctctcttttggcattaatcatttctgccttattttataattacttatgattttgatttatttccctctttaacctgtataatgctttaacatctagcatataataagtaggctttttttttttttttttttttggagacggagtcttgctctgttacccaggctggagtgcagtggcgcgatcttggctcactgcaagctctgtctcccgggttcacaccattctcctgcctcagcctccccagcagctgggactacaggtgcacggcgccacgcctggctaattttttgtattttttagtagagacagagtttcaccatgttagccagtatggtctcgatctcctgaccttgtgatccgcccgcctcggcctcccaaagtgctgggattacaagcgtgagccaccgcacccggccgtaagtaggctttttttaccttaattttatttttttgagatggagtcttgctcttatccccaggctggagtgcagtggtgccatctcggctcactgcagcatccacctcccgggttcaagcgattctcctgcctcagcctcccgagtagctgggattacaggtggccgccaccatgcccagctaatttttgtatttttagtagagacagggtttcaccgtgttggccaggccagtctcaaactcctgacctcaagtgatccactcgccttggcctcccaaagtcctgggattacaggcgtgagccaccatgcctggccataagtaggcttttactgagccttgtgtgtattggctatcctagtgattacagtgaaccagtgcccttcttattaatcacacatttaattgttccctaaaagtgattagttcactttatttatttagtaagacaaaaaatgaagaatactcttaactgagcagtctgttaactgtaggaaagcactgacacttataaggcttagttttctgtcatttatccagaagtatggttgattacagtttttacttttttatttgaatgaacaaccttaatttaaaatatattttgtttattttttgttgggatcgatacattgtccttgtttatagattagagcatgctttttaaagatgctgtattactcactgattttatttgtccagtgtacagagattgaagtgggaaaattataatggaaattgtttccatagtcattacatattaatttcatcaatttatttccataaaatctgtagattgctacttatttagatttttccttcaaatgtttttatgttgtattgcttgcactgagtatttattctatatgctcaatttgctggagaagaagactaattataacttaggcaagttgtaaaattagggaaaaaagtaaggtaccttacagcctagtttacttatttcttatgtaaagccagttagattccacattagttcaaactgccttctttgagcaaaacttgattggcagtgataaaggcttaaagcccttctcaagcagagacctgtaaagactagatctgactgtagtagaaggaaggaacttagatgtttcaggcagtgagaacaccagtcttccactctaaactttgccactaacagtatgaccttgggaagttgtaactttcttcagattcttcatttgttgaatggggggattggcctagctaatttctaaatctctactgggctaaaaaattctgtgcttatactctgattatgaagtacataatctgtgcttaacattcactgacttatccttaggataatacagaagcagtacaagaaacagcccctcaagatgtttgcagtctggttagaaagacaaacttatacacagaacagtagcaaatagaccaaaataataatagctgccatttatagaacacttcttctgttctgggcattagacaaaaactgactataacggtgaacaaaaaagacttaggtcctgccctcattgaacttacagattagtaggggagaggaacattaatcaagtaattccacagatggcttagcctagattggtagtgatggaagtaaagagatgtgaacggacttgaaaaaaaattcggaggcaaaatggatagaagtttattattgattaaatatgaggtgtgagagagagggatatttaagattgatacctaccttctggcttgcctaacagaaccaaaacaggaaattatatgttcagttttgttatgttgggtgggaggtgcttttgagtcattcatttatatatgttatatatgttattttatatgcatagtaattttaaggtctgagttttaaaccaaaggttagagagtgattttttagagtctagcaaacctaagttgaaatcctgcctgttgaaatggctgtttactagctcattaacctagggcaaagtattcaacttgttttcatttttgtcttcatctctaaaatgaggaaaatatggtcttacaagattgtcctgagagatagatgaaataatatccaaaaaaaaaaaaggtacatagagaaactcgtatagtgcctggtatatagtaggtcctccattggtagctatcattatctagttttaacatagccttcagtttgttgaattagtcaaactgagtgaagcactgcaaggaattcagaggaatttgagatcaacaaatgatttctgaagtttagggaagacttcatggcaatgacacttaccttgtataaaagttgaagaataagaaagatttgaatgagagattctttctcttctccctaccagcccagcttcttatttgaggatatattgggcaaaggggccttcagacaagtagagggagatttttacagaaagattgagatgaaggtatagaaggctgtaaagaccagaaaagagaattgagacagaggaagcaggaagccactgtaggtttttgagcaagatattgatgctgtaagtatggtgtttatgaaaggttagtctggaagagatttgcaggatggagaccccggaagtttttttgttataatacagaaagacttgcactgagggtgaggtgttaaaaataaacaggtaagtaaatgtttaaacatcttgaaggaaaagtcaacaaatcttggcaagtaaacagataacagtgaaaaagaatgggaccaagattttgagttttggagactggtggattgaacagacagggaaattgagaggagaatcagatgatgatgttttaagttgatatttagacagattgtgcttgagatggtaaagtcaatgtgggtgggaatgcttagtagcgagtaatcagtgatacaagaccaaagcccaggtcaaagacaagtcacagatacagatcagggctttttcatctgctccacagaggtgtaccctaggagctgttgcaaacagtccatgtggagggtgtgagtaagatgtttcccttgaatttgccagaattacttttttgttgttgttgttgttttttctgagacagattctcgctctgttgcccaggctggagggcagtggcgagatcgcgcagctcactgcaacctctgcctctcgggttcgagtgattctcctgcctcagcctcccaagtagctgggattacaggcttgtgccaccaagcccagctaatttcttttgtatttttagtagagatggggtttcaccatgttggccagactggtctcgaactcctggcctcgtgatctgcctgcctcagcctccaaaagttctgggattacaggcgtgaaccactgcacccggtcccttgttaagtttattttggtgggaagcaaaggaggtttcagcttttaaaaagtttgaaaattattgctctggtaataattaaagatttgagagtaaatatgctttctagcagaaagaataaaagaagaacagatagcctcaagaaggggagccaaagaagcaggctatatctgacacactgggtgttgataaatgggtattaaaagaatgagagcaatgagcagatagaagaggaaattaggagagtataataccatggagaccaagaaagatagactatcaggaaggagtggtaaaaataagttactagttctaagagagatgttaagagggaccggggaaagccttgtacaaatgagttagtagcattttacattatatacatctaattaagaaacaatgcgagagtctcaccattcctatagactcttacttgtacttgtctgaacacgaaaactggcttttgtttataaataagctaaaaattattttgctccaatttctcatgaaaataaaaataaaccttcttttaacattgaaaaaatagtttgaagacagtcactcttcattttgtaattcccacaactattattgaatgactgaaattatctttattctgaagccaaaggggtgatactgatatttcttcagactactaaaaatatattttatgaatttttagtgtgctttatctttttttgtttttttttttgagatggagtttcactcccgttgctcaggctggagggcagtggtgcaatctcagctcactgcaaccttcgcctcccagattcaagcaattctcctgcctcggtctcccaagtagctgggattacaggcacctgcccccacacccagctaattttttgtatttttagtagagacagggtttcaccatgttggtcaggctggtcttgaactcctgacctcaggtgatccacccaccttggcctcccaaagtactgcgattgcaggcatgagccaccatgcctggcctgaggaatatttttctaggttccccccaccccaagcatttattctgcaattttagttttgttcctaaagcaagcaaggtttaaggatttaaaaataatccgtattttagaatgctttctggctttgttactttttatccacagtagaagttctcagagaatgatctccctcttttaatttaactttttggcacagtattttgagaattataaataatattagaatgttttctggctgggtgtggtggctcatgcctgtaatcctggctacttgggaggctgaggcaggagaatcacttgaacatgggaggcagaggttgcagtgagccgaggtcatgccactgcactccagcctgggtgacagagcaagactctgtctgggaaaaaaaaaaaaaaaaaaaagagtgttttctttcctattttccaccacttgattaagttacttttcctcttaagtattttttgctgagtatgctgacttaagagtaatgttacaaaatttaatttttaaagttctctgaaagcccctttatgagagttttaggctatcaaattgtgtttaattcttaacaattttttgaaaaattatagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggtaagtaactatcattttttattaacttgtattagaaggatttgagtacaatatgtgaaacttctgtcataggatacagaactatataattggaaagtgctttggaaaaaatgtatttaaaataacagctacaagtataatgggtagctgtgttgtgttcctgtaaatatagaatataaagcatgcccagtagaaaaacaagcatttccagaagaaatatatctgatcactaaatataaatatatgaaaaagatgtctcactttattactgagggaagtgcaaattaaaataatcagttaatgttctcctaacacattagcatattttttaaagtttgacaatttgaatgtcagtgaagatgcagggaaatacccctcctatttagtgataatataatctggtgaagactctttggaaagcaatttggaaatcagtataaaatatgcatgtcatttaggccactctttctaagacctagccctcagatatgctcattcatatgtgcaggtgtgtatgtgtgtgtgtgtgtgtgtgtgtgtgtgtatatgtatgtatgtatgtatgtatgtatgtatgttgaaggctattcattatagtattgtttgtgatagcaaaaaattatggacaacatataaatatctgttatagggaaataaccaaattgtggtatacgcatgctctggagtataatatagccatttgtttctatttatttattttcttgagacagggttttactctgttgcccaggctggagtgcagtggtatgatcatggttcactgcagccttcacctcctgggcacaagccattctctcgcctcagcctccagagttactaggactgcaggcatgtgtcaccacacccagataattttttaattttttgtagagacagggtctcactatgttgcctaagctggtctcaaactcctggcctcaagcaattctcccacacaggcctcccaaagtgctgggattaccaacgtgaaccaccacacctggttcagtgtagccatttagaaatctaaaaaagacgtgggaaaatgtctaaggcatgtttaaatgtgagaaaagcaagtcacagtatgcatggtaaaatccgttatattaaaataagttcttccaaaacaaaaacatatgcaggagacctttattttgtcagtatttcttacccaaatttctgcacttagaaaattgcatgtcatgttgtcataagttgaaaaaaagatccatgaaccaatggacttctaataaaatcagtcctgcttttgacatctctctctacttttgtgtatattcaaaccagagtgtcaatgtgtttgtggggcacacttagcaataatacatagcagacaaaatgcatatagctcagagagtaaaattgtaagttttgctagatcactcataaattgctgatgagaatttaaaatggtgcagatgctctggaaaacaggcagtttctttctttctttttttttttctttttgagacagggtctcactctgttgcgcaggctggagtacagtggcgtgattacaactcactgcagcctcaccctcctcaggttcaggtgatcctccctcagtctcctgagtagctgggactataggcatgcaccaccacgcctggctaatttttgtattttttttttttttttttgtagagacggggtttcgccatgtttcccaggctggtctcaaactcctggaatcaagcgatccacttgcgtaggcctcccaaagtgctgggattacgggcgtgagctactgtgcctggcctaggcagtttgtttgtttgtttgtttgtttgtttatttatttgtagacggagtctcacaggctggagtgcagtggcccaatttttggctcactgcaacctccgcctcccaggttcaagctattctcctgcctcagcctcctgagtagctgggatgacaggtgcctgccataatgcctggctgatttttgtatatttagtagatatggggtttcaccatgttggtcaggctggttttgaactcctgacctcaggtgatcagcccgcctcggcctcccaaagtgctgggattacaggcatgagccgtcatccctggctggtggtttcttatgacgtgaaacatgcaattaccatatgacctagcagttgcactctgtatttatcccagataaatgaaaacttaccttccaataaaaacctgtgcacaaatgttcatagcagcttaatattgaaaaactggatgttcttcagcaggtgaatgaactggttcattcataccatggaataccattcagcaataaaaaggaacaaactgttgatacatttaaccacctggatgaatatcaagggaattatgctgtcagacaaaaaccagtccctaaagactacatatagtatgattccgtttggataatattcttgaaatagagaaattaagagaaatgaaaagattagtgtttgccagatgttagagacagggaggtgagaggggtaagtgggtgtagttataaaagtgcaacatgagggatctttgtgatgttgaagttgtatcttggcagtggatgcagaaatctcaatgtgataaaattacaaagaactaaaaacaagaatgagtatagataaaactggggaaatctgaacaagttagagtgttgtatcactgtcagtatcttagagtgatattgtactatagctttgcaagatgttaccatgggagaaactaaagtgtacaagggatctctaggtattattatttttttagagatggggtttcactatgttccccaggccggtcttgaactcctgggctctagtgatccgcctgccccagcctcctaaagtactggaattacaggcgtgagcgaccatgcctggccctttcagtattgtatcttagaacttcatgtgaatctagcattatctcatagaatttaattaaaagaaattgtaaacctcacagaagatcagaatttcctcaagtttgtgatgttgacaaagatgaactagttgacactgacagtaagactgaggatgaagacacgacgtgcttcaaaaaaatgatttgaatatcaatggattaagaagaactcttttgacaaattgatgaaaccctcagtcagttttataagaatgcccatctttatgatcatgctatgaaagccaatttttaaaaaaattttttgtctttcctaacaattagcttgtggttataatttaaatttagttaaatataagataaatgattttttattaagtttagtttcatttttcaaggtacgatctcaaagctactctttaacctactatgaatgaataatgctgagttcataacatctttgtagatatatccacaattttccctcaggataagtgcctacaagtggaattactggactgaaaataatgcagtttgctaagactttgctatctgttcctgaatgctcctccaaaaaggttttgccagtttacatcctcatgaccagcgaatgagagtgttgcctattttcctgtgcccttgttactgcttaataatttttgaaaaaaatctaatttgacagacaaaaatgcattttatgttaatttgcttttctgggatttttaatgaggttgagtatagtttttaatatttttattggcccctttggaactagtatcataagttttttttcttaagaatttatgtagtctgggctgggcgcagtggctcacgcctgcaatcccagcactttgggaggccgaggtgggtggattgccgaaggtcaggagtttgagaccatcctgaccaacatggtgaaaccgaatctctactaaaagtacaaaaactagctcagcgtggtggcgggtgcctgtaatcccagctacttaggaggctgagtcaagagaatcgcttgaacccgggaggtggaggttggttgcattgagccgagatcgcgccattgctctccagcctaggcaacaagagtgaaaagtctcaaaaaaaaaaaaaaaaaaaaaaaaaagaatttacatggtctgaattgccattaaaagagatatgagaattattgagtaacaaataactttttaataatttaggcaagttttggacgattgtactttgtttagaaaccaaaagcatagtatttgtagtttttttatttactttagttgctaggaagtaaactttattcaaggtctctggtaccagttgttgctaaaagtgattgactaatctgtcaatctgaaattatttgttgctgaactgctaattcttttgcttctatcttttaggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtgagtatgtgattttcttgtgtgtacatatgtgtctcactttctttttttaatttactaagcagaacttcagatgaggaataaaatgattggaatattttttttctcctctaactacttgtaaatttgggagaatttggagagtgtagtagagtcagatcagtgtatggaaaaggagcaggagtgactggaccttctaagaagtgtgttatcagaattagtaaatgaagggtcaaatgtcctacttttcccctccactgattttgacatcaaaccattatccacatagccttatttcctccctcggtcttaattttattaatattttactgcactttgcagataaaatttttaaaaaatttttaaaaattgccaataagtgacatttattaagttcagtgcttagtgtatatttggattttatttattagtcacaagacctttgtgcaggtagtaggcatgattatctttttttttttgagatggagtcttgctctgtcgcccaggctggagtgcaatggcgcggtctcggctcactgcaacctccgggttcatgccattctcctgcctcagcctcccaaatagctgggactacaggcgcctgccaccacacccggctaatttttttgtatttttagtagagacggggtttcaccatgttcgccaggatggtctcgatctcctgactttgtgatccgcctgcctcggcctcccaaagtgctgggattacaggcatgagccaccgcgcccggactgattatcttatttacacatgagaaaaccagggcttagaaaggttaggtaacttcctctaggttgtacagtaaatgtggacctagaagcattttgacaagagcacctgtttttttttcttctctattagtttagaaattatatactcttaattatcacctgggattttgattagacagccttcatgttctttttcatcttaaatgttctttgtgtcttaaagggctaagtgatttcttcagatcttttagttcactcattctcagtgaactaaaatgaggtctaatctgctactgaatcaagttttcagcatgttatttccttcctccctccctccctccttccttccctcaaccaggctcccgaggagctgggattacaggcgcccgccaccactcctggctaatttttatattttagtagagacggggtttcaccatgttggtcaggctgatcttgaactcctgacctcaagtgacccacctgcctcggcctcccaaagtgctgggattacaggcatgaatcaccacacctgacggcatgttattttcatcgcaaagttactgtaagctgggagaagtggcacacacttgtactcccagctactcaggaagcttaaggtgagaagattgcttgagcccaggagttttgagaccaacctgggcaacacagcaagaccccagctcaaacaaagaaaaaaagttattgaattttttatttctatggatcattttttgtagtttcttattcctttcacccttcattcccacttttgatcccatcttttatttatttagttttattaaatgtatatttgtctgataattctgctatctacagttttttgtggacctgactcagcatttctttgtttcttcggattcagactgttggtggcttgtgattttagtgatttttggccgtgaacatgtttcttggacttttgtctgtgggaattctctgtgtactctgtataaattaagttacttcaggtgttttgcattttcttttgccatgcacctggggcctgggtcactacccttctggtaccacttaaaactgaatttttgtcttgggtgctcgtactgatcctgtatgagtacaggtttatacttactgtagaaatatggtgtttgattatggggtattgtcccagatggtgctggagtattaatatgctctctgttaaacttaatgtgttgtccctgtaaaactccaaaattctgaattccagaatactactggccccaaatgtttaagataagggcactgcctgtatttgtttctgcctcccactattttccttagtttaacacaaactcacctttttaaaaaacattttgagagaattcagtattgggaagagtttctaacctgtttctggaaatggaagtccaaagtctgtttctgtaattgttttttttttgagatggagtctcactctgtcacccaggctggagtgcaatgacgtactctcagctcactgcaacctccacctcccgggttcaagcgattctcttgcctcagccccctgagtagctgggattacaggtgcccaccaccatgcctggctgatttttgtatttttagaagagatggggtttcgccatgttggccaggctggtcttgaactcctgactttgtgatctgcccacctcagcctcccaaagtgctaggattatgtttctgtaattgtaatacatttattgtttttagaaactgtctttgctttagtggtaattttcaataaaaatagaaatagcagtggagttattaaaagagcattagttacatttttccctttttcattatcttcaaatattatatatagtaagtttgacctttttaaaatgtatacttgtatcagttttaacacatacatagattcctgtaactgtcaccactataagggtaaagaacagttagttccttcacctttgaagtcaagccccacctctatcccaacacttggcaaccgctgatctttctccgtctcaatagctttgccttttctctttttttttcttatttttttttttgagacagcgtcttgctctgtcgcccgagctggagtgcagtgaggcaatctcggctcactgcaacctccgcctcctgggttcaagcagttctcctgccttagcctccctagtagctgggattataggcacgcaccaccacacccggctgatttttttgtatttttagtagaaatggggtttcaccatgttggccaggctggtctcaaactcttgacctcaagtgatccacctgcctcggcctcccaaagtgctgggattacaggcgtgagccactgtgcccaatcaggactttttttttttaaatttacattcaacttgtcatttttttcttgtatggattgtgccttcagagtcacacctaagagccctttgcctaagcaaaggtcatgaagattttctcatatgtttccttttaaaagtattgtggttggccaggtgccatggcttatgcctgtaatctcagcactttgagaagctgaggtgggcagattacgaggtcaggagatcgagaccatcctggctaatgcggtgaaaccccatctctactaaaaatacaaaaaaaaaaaaaaattagccgggcgtggtggcgggcacctgtagtcccagctacttgagaggttgaggcaggagaatagtgtgaacccgggaggtggagcttgcagtgagccgagatcgcgccactgcactccagcctgggcaacacagtgagactccatctcaaaaaaaaaaaaaaagtattatggttttacactttacgtttagatatatatcttttttgagttaatgtcgtataagtatgagggttacgtcagattttttgttttttgtttatttttacatatggatgtctagttgttctaataccatttgttgaaaagacaacctttactccattgaattgcctttgtacttttgccatatttgtctaggcctgtttttggactcctttttctgtttcatgatgtgtgtgtctattcctttgttaataccacatggtcttaattactgtatagtaagtcttaaaattgggtaatgctggccttataaaacgaattgggaagtttttatttttactcttatttccattttctagaagagattgtgtagaattggtgtcatttcttctttagatatttggttgaattgggaagtgatgccatctgggcctagggttttgttttttgtgtgtgagacagagtctcacttctgtcacccaggttggagtgcagtggtgagatcttggcttactgcaacctctgcctcccaggttcaagttatcctcctgcctcagcctcccaaatagctgggattacaagcgtgtgccaccatgcccgactaatttttgtatttttaatgcagacagggtttcaccatgttagccaagctggtctcgaacttgtgacctcaagtgattagcccaccttggcctcccaaagtgttaggattatagatgtgagccaccgtgcctggcaggggcctagggttttctttttcagagtattttaaactatgaattcagattatttaatagatataggactatttaagttatctgtttcttcttgagtgaatttttactgtagtttatggcctttgagtaattaattgtattgaattgtcaaatttatgagcgtgtaattatttatagcatttcgggtttgtagtggtatccctcttttattcctggtgttggcaattgtgtcttgtttttctttgtcagattgtatagggatttattagtcttttcaaagaactagcttttgttttgatttttctgttgttttgttttcaattttattgattttctgctctttattatttcttttctattatttctgcttgctttgggtttattttactcttttttttttctccaagttgcttaaagtagaaacttagatttctggtttgagacctttcttttctaagataagcatttaatactgtaaatttccttctaaccactgctttagttacacccccacaaattctggtattttgaactgagcacaaatgaaatgttctaatttcccttgaatcttattcttttaccaatgaattatttagaaatatgttatttagtttgcaagcaattggagacttttttcctgttatttttctaccatttatttctcatttcattatattatggtcagagaatatattttgaatgatttcatttattaatttttaaaaataacattaaaaaattttttaaaatgtgaatataccacatacagtataaagattgtacattctgtttttggacagttttctataaatgtcaagttgatttagttggttaatgatggtgttcagtttttctttattcttgctgatactttgtatgcagttatatcactttattactcagaagagtgttgaactttccaactacaatttttttttccaattttactttcagctctatctggttttgcttcatgtattttgaggctctgttgttaggtgtgtacacattcaggatgatatcttctgggtgaattgcctgttttatcattatgtaattccctctttatggtaattttccttgttctaagatcagaaatatctgttgtccaatttatatagacactgcagctttcatttgattagtgcttgcatggcatatctttttccatttttttacttttgatctacctttataattctatttaaagggggcttcttgtaggcagcatatagttgggtagtgttatttatttatttatttatttatttatttatttatttattgagacagagttttgctcttgttgcccaagctggagtgcagtggtgcaatcctggcttaccacaacctccacctcctgggttgcagtgattctcctgcctcagcctcccaagtagctgggattacaggcacgcgcaccatgcctggctgattttttgtatttttagtagaaacggattttcaccatgttagccaggctcgtcttgaactcctgacctcaggtgatccacctgctttggcctcccaaagtgctgggattacaggcgtgagccactgcacccggctgagtcatgttatttttaatcttttctcacaatacagggtttttgttggtaaatttaattattttaatataaattttagtataattatttacattaaatgtaactgttgcactggggtatttataatgtgtaaatataattattggtattaatataattatattactcataataatattaatatctttggatttagattaccagtttagtatatgtttttctgtttctccctctttgatttccccttttttgctttttttttttttttaattcttatttttttttagtatttgttgatcattcttgggtgtttcttggagagggggatttggcagggtcataggacaatagttgagggaaggtcagcagataaacatgtgaacaaggtctctggttttcctagacagaggaccctgcggccttctgcagtgtttgtgtccctgggtacttgagattagggagtggtgatgactcttaacgagcatgctgccttcaagcatctgtttaacaaagcacatcttgcaccacccttaatccatttaaccctgagtggtaatagcacatgtttcagagagcagggggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaactgccatcgtcatcatggcccgttctcaatgagctgttgggtacacctcccagacggggtggcagctgggcagaggggctcctcacttcccagatggggcagccgggcagaggcgccccccacctcccagacggggcagtggccgggcggaggcgccccccacctccctcccggatggggcggctggccgggcgggggctgaccccccacctccctcccggacggggcggctggccgggcgggggctgaccccccacctccctcccagatggggcggctggccgggcgggggctgccccccacctccctcccggacggggcggctgccgggctgaggggctcctcacttcgcagaccgggcggctgccgggcggaggggctcctcacttctcagacggggcggccgggcagagacgctcctcacctcccagatggggtggcggtcgggcagagacactcctcagttcccagacggggtcgcggccgggcagaggcgctcctcccatcccagacggggcggcggggcagaggtggtccccacatctcagacgatgggctgccgggcagagacactcctcacttcctagacgggatggcagccgggaagaggtgctcctcacttcccagacggggcggccggtcagaggggctcctcacatcccagacgatgggcggctaggcagagacgctcctcacttcccggacggggtggcggccgggcagaggctgcaatctcggcactttgggaggccaaggcaggcggctgggaagtggaggttgtagggagctgagatcacgccactgcactccagcctgggcaacattgagcattgagtgagcgagactccgtctgcaatcctggcacctcgggaggccgaggcaggcagatcactcgcggtcaggagctggagaccagcccggccaacacagcgaaaccccgtctccaccaaaaaatgcaaaaaccagtcaggtgtggcggcgtgcgcctgcaatcccaggcactctgcaggctgaggcaggagaatcaggcagggaggttgcagtgagccgagatggcggcagtacagtccagcctcggctttcacaactttggtggcatcagagggagaccggggagagggagagggagacgagggagagccccttttttgctttcttttggattatttgaatttttccttaaatttatttatcttacttatttatttatttttttgagtgattctcctgccacagctcccaagtagctgggactgcaggcatgtgccactacacccagctaatttttttgtatttttagtagagacagggtttcaccatattggccaggctggtcttgaactcttgacctcaagtgatccacctgcctcggcctcccaaagtgctgggattacaggcgtgagccaccatgccctgcctttttctagaatttatatattgagttcttgattgtatctttttatgtaggctttttagtggcttctctaggaattacaatatacatacttttcacagtgtactcacatttaatattttgtaacttcaagtggaatgtagaaaacttaaccaccataaaaatagaactagggatgaggttaaaaaagagagagaaaagaaatgtaataaagatttaataacaccgtttttttttttttttctcttttttttttgagacagagtctctctttctgttaccaggctggagtgcagtggcgtgatcttggctcactgcaacctccgcctcctgggttcaagtgtttctcctgcctcagcctactgagtagctgggattacaggtgcgcgccaccatgcccagctaatttttgtatttttagtagagacggtttcactgtgttggccaggatggtctcgatttcttgaccttgtgattcgctctcctcagcctcccaaagtgctgggattacaggcgtgagccaccgcgcccggctaagtctttaaatatttttttgacattgcactttttctcttttccttctaggattttagtaacccaaatgttagttttgttattgtttggcaggttcctgaggctttccttacttctttaaatttttttttcctgttgttcagcttcgaaaatttctattcatctgtcttcaaattcactggttctttcccgttatttccattctgttattgagtctttgtagtgaattttaaattttgtttattatgttttttagttctaaaattttctttttttgtgtatgtcttatactttgctcctgaaactcttatttgtttcaggagtgatcttatttcttagagcatggttttagtagctacttaaaatttgttttatcatcccagcatatgtgtcctcttgattgtcttttctcttgtgagataatgggattttctggttctttatatgacaattaattttggattgtatcttggacagtttgacttacgttacatgattctgaatcttgtttaaatcctgtggaaaatattgaagtttttgctttaacaagcagttgacctagttaggttcagtccacaaattctaagcagcattctgtcggctctggttccatcatcagttcagttttgtatcttatctgcttatgtgcctttctgtgtccagtctgggacctggccaatggtcaggtcccaaagcctttgtacacttttagaagcagggccatgcacacccagctcacgagtggccccgggagtgcacatacaactcgacgttttcatgggctccttcttttctgtgatgtccctgacacgttctgccttctaagaacctccctttatccctttcctgttgtctggctagaaagtcagggctttagattccctatacttcagcacacttcctgtagctatgtcaacctctgtggccacgacttcttcttcttgggactgcagtttctcttgtcagaaagtaggattcttggagctgctgtcattgctgctgtggctgctctgatgctgcctgggagtcgaaggagagaaaggaacaaaacaaaacaacccaggggatttcctccactctctttgatccgtgagagccccctttcctgttcctcagaccagaaatagagggcctgtcttggaacttcttctttgtgcatctggtgtgcagtttcagcttttgagtccaggccaggaggtgctggacaaacttgtcaggagtacggaggtactgcaagttctgattacttttctcagtccacctgcttccaagtccttggatgcatttgtccattgttttgagttgcattccatgggagagacagaagagtgtgcttatttcatcttgacatacttattaggatttcatatcaaatcaacggatgatattctctatattaatttgctgttttccctttagcaagcacattaggaaaataacactttaacacccgcctttggtggtttctgtcataattattaatacttgactttttttttttttttgagacggagtctcactctgtcctttgaggcattgtccccataaacttttggtaaagcatcaataattttatctttcatccacacaagcttcaccataaatttgatgtttattcttccattttagcagaattcatgttgctccaataggggctgtcttcaaactgatgttttctccttcttagtgcctcagagtagatcctgttcagatacgttataacaggttaatatgagtttattttggtgtaaaagtactttgaaattcatgcatagttttttcatcatatgcattttccatagctttgaacacccccatgtaactctcctcttccacaaaccaaacaatgaaaaagcacctttgtgatggaagtttattttgcaataggaactcacagtgatctaagccctgctattcatgaatataattcattactggagtccaagttgctttttggtttttgaagttctcttcttcccttgcaggtatagaacaagatgcagtgaatacttttaccaaatatatatctccagatgctgctaaaccaataccaattacagaagcaatgagaaatgacatcataggtaagcagtgcttgaaactatggcaaaaaaaaaatgacaaaaaatgcacagaactgacaattttcgttattgactaagataattttttcttaacatggaatttagcagttcccttcctaatttgttttctgagtattttttatatcggattatagctcactttaaaagtttctcggctgcattcggtgcgagggtctttgcctgggccagatgggctgcagtgtagcgggtgctcaggcctgcccgctgctgagcagccgggccggcgggcggctacgctaaccggcacagaccaccggatggactggccggcagccccgcaccagtgcacgaagtgggcgggacagaaacttctggggttggaagtccagtgaggctaaaagccggtaccaaagtctctaggcatcagggctgcagcccaagagtctcacgaccagtgggcaactggatggccagacaggtgtctcagtggtggcctctccgtctcagggcttcatcccacttctcagtgggcctgacgtccctgggcaccctggatgtctacctgcattagccagagccatcacatggcctgtgacttgcctttttttgccagttgattgtgccacacacagtgtcatttctgtgtcatttggcacagctggaggtgcaaggaggagggcagcctcatgtccagtcccagtttcacgtaactttattcttctgaataaagacaatttgctaaccttaaaaaaaaaaaaaaaaaaaaagtttttcttatatgttggacccaaattcttaggctttaacctgaataacaatgacagcaagatcaataaatagtacacatttattaaacactcactgtgtcccagacaatattccaagcactttttatggatagactcattttaacttctaaagaactttgtgggataaatacagttattttatagatgaagaaactgaagcacagagaagttaagtgctttgtccagggtaacagctcagatatggcagagtcaggatttgaaactagaccctcacataccttaactgctgtgctgtggcagtgtttttcatactgtaggttgggaccagccttctcttatgccctcaccccctgccaaaaaaaaaaaaaaaaaaaaaaaatatatatatatatatatatatatatatatatatatataatatatatatatataaaatatatatatatataaaatatatgtattagtatatatgcatatatagtatatattatatattagtatatatactaatatataatatacatattagtgtgtgtatatatatatatactagaataaaaaaatcaaagtatctcagagtagtaaggacaaacatttcagaaaaatgttttcattatatatacatgtatgtatgtgtatgctgattcaacaaatatatttcttataggttatagcaaaatagtttgaaagcttttactgtgttttatcaggaagaccttaggtgaacgtatattcacagataaaagaggttatttattcattcaataaatattacattctcataagtcctaatattatgtatttttattcttcaaaaaagttagtatttgtgatttatgaaataagacatgttcttgcacttttagcagatctgtcccgatgttgggcttctttaatccttagtgtgggtgctttgcactcactcactgctggggacagcaagacccctgttagtctcagctgtgtttcttaaattggcccactgtaccttccagttagctattctggggtccatgtcatgttggctccattttccttttctttctcccacacagatacctataacggctataacataggcctggtggctgttggtggcttatccctatctgcttgtatttaaggggtactgtttcactgagttttgctgacagatgttgtcatgagatttgaggttttctgtgttgttgctctatttttatgtgggaatttgctactatcatcatccctagaccagcttttcctagtaatacaacagggatgttctgactgattagagtttgcctgtttgaagaattggttggctagtgatttttttttgaggggagtctgtaccagttaatagcctgactggcgtgtggataaaaaggaagcagtttcaagtcaaataaaacacttaaaatgaaaccacactgcaactctctttcttttacttaagcttaatcaaattaatgatgatgtaatcccatgaaggaaaagtcttctgaaggatcaagttgataacattttgtgatcaaagaatttgagaaaacctctatcccagtgtctatcattatatattttaggatgttaattacctgtgtggctttaggcaagtcatttttcctccttgagccccattcttaatcctgtccaaattatttgtctcctcttgcagttggactattttaatatagctgtccttcaagtgagttttgttcaaaggagccttcactttagctcttactgtgtacccactttgcatagtcttgttttaaatgtaatccttggatttttggtgttgctaactaattactgtttttatgtgaggatttagagtgatccagaatctatacttgcactacctccttcatcttccacaaatgtttgaagtggtagaatttttaaaaactttgaaggtacagctgacagaatttgctgatggtttggaagtgagtggtatgagagggaaaaaaaggaataaagcatgactgcattttttgtttgtttgtttgtttgtttttgagacggagtctcactctcgccaggctggagtgcagtggcgtgatcttggctcacggcaacctccgcctcctgggttcaagcgattcccctgcctcagcctcccaagtagctgggactacaggcgctcgccaccacgcctggctaatttttttttttgtattttagtagaaacggggtttcaccgtgttggccaggatggtctccatctcctgacctcatgatctactcaccttggcctcccaaagtgctgaggttacaggcatatatataagcatataaagtgtgttatagcatacaaacaggtatatatataaacatgcagtccacacagctgataggaatgaggcagtagtgaaggagaagttgatgtaggagaggggacagttgttacaggaaagaagtctggaggcagaagggatgaattccagtgctcacatagaagattgcttagatgggagcaaggacaatttatctagagtcacaggaaagaatgcagtacacgggtagagatgcaggtgagttgaaagatgtgagagatgatggaaataattttctgattgcttctatattctcaaggaagcaggaagcaaagtcctcagcaaagagaatagaagaggtgttaaatatttgagaaaggagatgtactgtagaaaaaaaaaaaactcagtttctccttctgaactctcacaaaacagaacccttccatgactctagttgtgtggggttttttccctgtcagctaccaattctgcagatgattgttcagtgaacaccaactgggtgtcctctaagtcagttcagttctcacactgtttacctggagatagcatcagatcccacagattgaggactctgtcccacaagactgcctccacttcagatgccagtctcaagtacaagttgtggcctgtgcttctgactgaccttctataaattggagttcccacagtcccctccttgggttcaataaatttgctagagcagctctcagaactcagggaaatgctttacatatatttacccatttattataaaggatattacaaaggatacagattgaacaggcagatggaagagatgcatgggcaaggtatgggagaggggcacagagcttccatgcactctccaggtcatgccaccctccaagaacctctacagatttagctattcagaagcccccctccccattctgtccttttgggttttttgtggagacttcattatataggcatgattgatcattggctattggtgatcagctcaaccttcagccccctcatcccgggaggttggtgggtagggctgaaagtcccaaacgtgtaattctgccttggtctttctggtgattagccctcatcctaaagctctttagaggccacagccacaagtcatctcattagccttcaaaagaatccagagattccatgaattttaggcgctgtatgctaagaaactggctaaaggccagttgcaatgtctcaggcctgtaatcccagcactttgggaggctgaggcaggaggatcgtttcaggccatgagatcaaaaccagcctggtcaacatagtgagacccccttacaaaaaatttaaaaattggccaggcgtaatagctcttgtctgtagtctcagctactcagaaggctgaggatcactgagccctggagttgaaggcagcagtgagccatgatcgtgccactgactccggcttgggtgacaaagtgagaccttgtctcagaagaaaaaggaaaaaaaaaaaactgggcaaagactaaataacatatttcacagtatcacagatttgtattgtctaggaaagtgaatgtaaacagaccaggacactagtatgatcccttggtttcatgaaggtcccactaaagtcatgaacacaaagtgagactaggcatcatgttatatggtttttccagccatgtttaacagctagctaaatagctaattgtttcgctgcagtttattttagcagttccttattttagcacatttcatgttttaaaatttctaccaataacattttaataaacttttttacagataacttcacaaatccataattttttaagttacaatcccagaaatagaattgctcattgaaagggtatgttcatttttaaagttatgctagaaactgccaaattgccttcagaaaaaggtgtttgtatccccactaacactagtgttagttttcttgtgcccttgctcaagtatacatattattaaaaacaatgttgggccagtttactagataaaaggtgtagtgcctccttattctaatctatttgattactagtgagtatgtatgtcttttcacgttggtcattttatgtttgttcctttgtggattgtcatgtcctttgctcatttttcttttggaacatttcttagtagtttataagagctcttggtattttaatgatagtaaccttttaactgtcatgcatgctgcaaatcttttttctgtttgtttgcctttgtattttgtttttggagggtttctatgtataggaattaaattttatgttgttaaatcttttgatttctgcttttgcatatgtacttcaaaagactttctattttaagatcaagtgttacctgtattttcttttagttctatttaaaacctcttaatttatatgcctgtgctgttaactcccaagttgattcacaagtgtgtatacatagtttgaatttagtggcaatttaattatttacaacttcttttgcagcaaggatttgtggagaagatggacaggtggatcccaactgtttcgttttggcacagtccatagtctttagtgcaatggagcaagagtaagttagttcatattttcacattgtgcatcctagggaatttgggttcattgttaggaatgggcttcactcagctaaaaacaaagtatttttgagaatttaaatattttggatatttacaagatcatataaagcatactctatcttggttaacagtttcttttaaatataaattatgtgaactcttaaaattttcattttcattttcaatgttaatatttcctaagttaaaataatttgtttttagttctgaaataatttggggagtgattgagtctgtagtgattatgactattagaattggtttatttatttaaataatgcatgtcttcagatggctctcctaatttgttagttaggctttaagctaaatggatgctatataactaaatccacatagatttgttgaaatggctccagaggttttttagatttattactgctatgtgcccttaaaaaaaatctattcattctttcacttaacatttatcagaagagtgctctgtgtaagacgtggttaggcatagtgccagtcttgaaggaagttacagcctaataaaagacatagggcatgttgtttggttactgtaatatgaagtggcatgtgttaaatgtcaggggagaactacaaagtcataaaaaggtgggagagattacatacaggtaaaggaatcaggaatgacaccatggggagtaaggtagtgttgacctaggcctttaagatacaatagggacagtatggaaagagtatatttttcccacttaaactctttccttggtcgttccctcaaattttcccttttgtccatgtgcaggcactttagtgagtttctgcgaagtcaccatttctgtaaataccagattgaagtgctgaccagtggaactgtttacctggctgacattctcttctgtgagtcagccctcttttatttctctgaggtaaagtctgcatttcttttcacactctattcgagcattccagcctctaactatcaatgctggggccctgtctataggaaataacacagaagagccaagtcatttccaaaaagatgtatcattgtttcaagttgtttctgatggcaagagtaatttaataatatattagagagaacatgaaaattcaatgtattaaataactctaattttgagaaacctaattaaactactgcatgtaagagagtgcatgtttttaattatttggagctattttaaaaccacagaatttgaaacttgcttccagtgcataaattgcagaccagacttcagaagagaaaaaaagtagtaaattttttcttatgctcatcatttttactttagtcacttgataggattgcccagtgaagaagcatttgcaacagacaatgagtatattaatctttttgaggcatacagtttagtataatgctctttgttaggcttcaacaagtgaaattattttgttggaaagcaaatgactattaagtagaaagaggattcccagtctcacaaagcagtaatttagacactcgattctgcctctttacaagaatacaggtactcagttgatttgttttctcactccctttctttgctataagtttaaatcaacaatttgtttaggttaatatgtcctcatggaatggtggaaatgatcagatataaaatatttggtttggttagtttactctttatatgtttgctggcaaggaaccacaaatccagtttagtataatttttactctagttcactaaaagtttgcatccagctgtgtaggtagtgtttgtttcttgttaacttttttttcgtctaaaagaatactttaaaacttttcaatctcaaatgactgtaacttgctgacaggtgttaacagaagaagtagatctttttgttttttgcttatgacctgtattttaatatttgagcttatagattagagattgtgagagaaatctgtttatagtcttattttcccttgtgtattttttcttcctagtacatggaaaaagaggatgcagtgaatatcttacaattctggttggcagcagataacttccagtctcagcttgctgccaaaaagggccaatatgatggacaggaggcacagaatgatgccatgattttatatgacaagtgagttatattgatagatggattcagcagatacttattgaacatttgatatgttttgtggaaataaagatgaataaactcagtctctgttgtcaaggagctcacaggaggcagcataaaagctgcttttatatggtgtttgtaaagctttgggggttcttagaacaaaagtttctgctgggaaaggggaggtgtatgtggggtaaacaggatggcaatggtggtgttcaaggagtgtttcccagaagagagattttgtttggatcccaaagaaagaagggaattttgctacccagagaaggcagaaaacaacattctaggcaaaggcattggcccagaagccatggaaacgtaggggaaagtggcactttcaagaaacttgagtttagataatcaaaggagtggggaataaatatgaggatgctggtactaattggaatagattgtaagggaccttgaatgcctatttatgggtatattatactttctgtataaatctgctcaggcacgttgttaattagttttttattagttttcactgaaaatgagaggatggaaacatcatacagtaaacaaaattgaaaatatctggtcaggcagatgatgagcttgtggccagctctgtaacgtatggtattcttttcatttaacttttcttactctgtaaaaaaagtaattcgtggtcgggcacggtggctcactcctgtaatcacaacactttgagaggcagaggcaggtgaatcgcttgagcccaggaatttgagaccagcctgggcaacatggcaaaacccgcctttactaaaaatacaaaaattagctgagcgtgatggcgtgcgcctgttgtcctagctacttaggggcctgaggcagaaggatcacctgagccttgggaggtcgaggctgcagtgagctgtgatccactgtactccaccctgggcagggcagtagagtgagaccctgtctccaaaaaaaaaaaaaacaacaaaggtaatttgttatttgtatccttaagcaaatgctaaaggggtaacttggggatagagaaaagtccacagatgttagggtttgaagacactaatagtatctaggccagtggttcctgaacattagtctgtgggctcttgctgggctgtctgcataggaatcacctgagagcttattaaaaataggttttcaggctggttgcggtggctcacgcctataatcccagcactttgggaggctgaggcaggcggattacttgaggtcaggcgttcaagaccagcctggccaacatggtaaaaccccgtctctactaaaaatacaagaattagccaggcatgatggcacacacctgtaatcccagctactcaggaggctgaggaaggagaattgctcgagcccgggaggtggaggttgcagtgagcggagatcatgccactgcactccaggctggctgacagagggagactctgtctcagaaaaaaaaaaaaaaataggttttcagtctgggtaccggtggctcacacctgtaatcccagcactttgggaggccaaggcaggcagatcacttgaggtcaggagtttgagaactgcctggccaacatagtgaaaccttgtctctactagaaactacaaaaaattaactgggcattttgacgggtgcctataatcccagctactagggaggctgaggcaggagaattgcttgaacccgggaggcagaggactgcatctcaaaaaaaaaaaaaaaaaaaaggtttccagtccccctgtctcagaaattctgattctgcaggtttgaggtgtgaccaggaatctttatttttagaagacataccagataattctgataaatagccagtttagggatgtagtctaattttcctattttgcaagtaaggaaaataaggcccagagaggtaatgattttctcaaagtcacagaacaagttagtggcagaatttggactggaatgcagttcttaatgttctgtccagtgtttattctggtacagtatgtttgtagaaggtattacgtaagaaacattgttatatagatgttgagataggaagagtttacatttagaaatttggtctaaaatgcctgaacattcaagtcgtggaggagtattgaccaacttactcaatacaacataggagattcacattttgttacaaaaatgctgatttaaaaggagagttttcttttttttcttcttttttattttttgagatggagtcttgctctgtcacccaggctagagtgcagtgacacgatctcagctcactgcaacctccacctcctgggttcaagcggttctcctgcctcagcctcctgagtagctgggattacaggtgggggccaccacgcccagctaatttttgtatttttagtagagacagggtttcaccatgttggccaggccggtcttgaactcctgacctcaagtgatccacccaccactgcctcccaaagtgctgggattataggcgtgagccactgtgcccagcctgcttgtttttgtatcatatatatgcatcatcataatcatgcattatcaacctttgtatttctgtcaggacatagaaaccattagagtgcttggaagagagcctttttttttttctcgcatttaatgctttttttggtattcatttcataatcagcttaccaaaacattacctgcattataccccatcaaggtagaaatctttgtgttatcaatattggttactccctttccacaccgagtcatcagtaagtcctgttctatccaaataggtcatatgcatctagctcacccctcagtgctgttttgttttgaatttgtacatgtttactcctgatgccttgtagttatgatgatgtgttcttattttattctgtgcatacaagttctcagctcgctttttagggaaaatgaccatgtcttcctttcctataaattcctttctatctatcaagtcctcaacagagaataggtacccataaatatgtgattgttagtttctttgcctcagttgtagtctgatccttacagcttttaaacaacagtagagttcaccgtcaagaactaaggatggttggcaggcagatagaaaggtagcaagttgacccaactatctctggggaagtgggaacaaagaaaggttacatcagcactgtcatcacatagctctatagttctaggcctgcaggctcaatcaagtagccttgtataagattctctggaggaggtgctgaaagttgcttatacttgctatggaatttgattttacttcggatatctttttaccataggtacttctccctccaagccacacatcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagtaaaaaagaaaaaagaaaaactaaaaagataaaagaataaccaagaacaaaacaaaaaaaattataatggagctgaaaaatctctgttgcctcatatttactgtactatacttttaatcattattttagagtgctccttctacttactaagaaaacagttaactgtaaaacagcttcagacaggtccttcaggaggtttccagaaggaggcattgttatcaaaggagatgacggctccatgcgtgttactgcccctgaagaccttccagtgggacaagatgtggaggtgaaagaaagtgttattgatgatcctgaccctgtgtaggcttaggctaatgtgggtgtttgtcttagtttttaacaaacaaatttaaaaagaaaaaaaaaattaaaaatagaaaaaagcttataaaataaggatataatgaaaatatttttgtacagctgtatatgtttgtgttttaagctgttatgacaacagagtcaaaaagctaaaaaaagtaaaacagttaaaaagttacagtaagctaatttattattaaagaaaaaaattttaaataaatttagtgtagcctaagtgtacagtgtaagtctacagtagtgtacaataatgtgctaggccttcacattcacttaccactcactcgctgactcacccagagcaacttccagtcttgcaagctccattcatggtaagtgccctatacagatgtaccattttttatcttttatactgtatttttactgtgccttttctgtatttgtgtttaaatacacaaattcttaccattgcaatagtggcctacgatattcattatagtaacatgtgatacaggtttgtagcccaaaagcaataggttgtaccatatagccaaggggtgtagtaggccataccatctaggtttgtataagtacactctgtgatgttagcacaatggcaagcagcctaacggaaattctgtttattgattgattgattgattgattgattgagacagagtttcactccattgtccaggctggagtgcagttgcacagtcttggcacactgcaacttctgcctcccaggttcaaccaattatcctgcctcatcctcccaagtagctgggattacaggcaggcaccaccatacctggctaatttttgtattttagtagagacagggtttcaccattttggccaggctgttctcgaactcctgaccttaagtgatctgcctgctttggcctccgaaagtgctgggattacaggcatgagctaccatgcctgggcagtaactgaaattctctaatgccattttccttatctgtaaagtgacgataatatgcacgtttacctcaaagttactttgatgattaaagtaaggtaatgtatataaaatacatattaacatagtacctgacacatggtaagcatcaaaaaatgttaactacttttattactattattattacgtatttttaaataattagagagcagtatcaaaaattagctgggcgtagtggcatgcacctatagttccagctactcaggaggctgaagctggaggattgcatgagcctgggaattaaaggctgcagtgagccgtgttcatgcccctgcactccagccttggtgacagagcaagaccctgtcttgaacaattaaagaaggcattatgccgcaacgttagcttagaaatgatccacatatatcaccagtaactgtcaacaggattggaaccctagttttgggtattatgatcacaaggtattattaatagcttattaataataaagcgttggctaggcacggcgactcacatctgtaatcccagcactttgggaggccgaggtgggtggatcacctgaggtcaggagtttgagaccagcctgaccaacatggagaaaccccatctctactaaaaatacaaaattagccgggcgtggtggtgcatgcctgtaatcccagctacttaggaggctgaggcaggaaaatctcttgaacccgggaggcagaggttgcagtgagctgagatcgcaccattgcactccagcctgggcaacaagagcaaaactccgtctcaaaaatataattataataaataaataaaagtaaagtattgatgtttgtgaatgatttattcttctaatgaactagaggagatttttccaggaatttcagagccagtgaggttatgttgcttgtatgtgtcatgtgtatccaggtgaaaaaacttaattaaacgctattatataataccatacataaaaactgaattttaggaatactgaagaatgacatatagaagtcaaatcattaaatagctagtagtaaacagaatagagtgtcagctgttacccaatgatgataatattttcacgattaaaattaaaccttttctgattttaaaggaaaagttcagatctgtatcatataaagaatgtaaattttcagggtaataaaattaaaatgcagagagaaaaatgcaaaaatagttcttactagatgtgtgtatgtaaggaacttagactaattttaagaacactgtcaagaccctggtagttaggtaggaaaaaagacatgaatgattcattcaacaaaaactttgagtatttctgtgctagatggtagtgttacagtggtaaacaaaataaatgtgtttctgctatcctggagcttagtctacaaaaaaggtacatattggccgggcacggtggctcacgcctgtaatcctagcactttggaagatcgaggcgggtggatcacctgaggtcaggagttcaagaccagcttggccaacatggcgaaaccccgtctctactaaaaatacaaaaattaactgggtgtggtggcggacacctgtaatcccagctactcgggaggctgaggcaggagaatcacttgaacctgggagacagaggttccagtgagtcgagatcatgccactgcattccagcccgggggacaaaagcgaaaatacgtctcaaaaaaacaaaaacaaacaacaaaggcacgtattaaatacgaacataaatatttacaaattatactgaataagttctcatgtttattatttgcttgtccagttacaaacttttccttcgtagaattagaaatataaataataaacatgagaactcattcagtataattaataattattaaatgtaaataaaaacatctatgtacaattaggcatttatttaagaattatttgaaaaaaaaacaatgtggaaacagatattttgatatattgctagtgattgaaattgataatgttcttttgaagagtaaagtgaccatatatattaaagttaaaatttaactcagcaatcacacgcctggtgagttatcttaaggaaatcagtttgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttttttttttttagacagtcttgctccagcgtccaggctggagtgcagtggtgcaatctcggctcactgcaacctccatctcccaggttcaagcaattctcctgcctcaggcctcccgagtagctgggattacaggcgctcaccaccatgcctagctaatttttatagtttttagtagagatggggtttcatcatgttggccaggctggtcttgaactcctggtctcaagtgatccgtctgcctcggcctcctagagtgctgagattacaggtgtaagccactgcacccagccttatgcattataattttaatttgtaaactgtacaaagggataatacttgtagtacaacaagaagtaaaaacatttgttataggtagttaacatttgtaaccagtagaattataggtaaaatttatttatttaaaacagttttagttggatttgatttcaactttaaaataatgcttttcatctctatcaggtctttttgcctggctttttgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcaggtattaactgattgcgtctgccattagggagaaaagcatacacatcctttccttcacatcccagtaacagatcctattatttgtaaattttaagttgtggaaaaaaaagataaaagccaggcacagtggcctgtgcctgtaatcccagcactttgggaggctgcggtgggcggatcacacgaggtcaggaattcgagaccagcctggccgacatggtgaaaccccatctctactaaaaatacaaaaattagccgggcatggtggcaggcacctgtaatcctagctacttgggaggctgaggcaggagaatcgcttgaacccaggaggcagaggttgcaatgaaccaaaatcacgccactgcactccagcctgggtgacaaagtgagactgtgtctcaaaaaaaaaaaaaaaagagagaaataaaattagcctacttactatcttctaatcaaagcatttgtggtaacttaaaatatactgtattgtaaagtatcatgctgtttcatttaggccattattctatttgaatctgtggctgtttctcttaataaatcaagtaatatggaatatattcatagcctctgaagagctctttatgtaagtatttatttaggatactttttgtaaaataagtgaatgaattcttaggtctcctttttttttcttttcttgagacagggtctcctcgctgcaacctggaaattctgggctcaaataatccacccaccacagcctcctgaatagctgggactagaggcatgcaccaccacgcctggctaatttgaaatttttttttggccaggcatgatggttcacgcctgtaatcccagcactttgggagaccgaggcaggcagatcacgaggtcgggagatggagaccagcctggccaacgtggtgaaaccccgtctctactaaaaatacaaaaattagctggttatggtggctcatgcctgtaatcccagctacttgggaggctgaggcaggagaatggcttcaaccagggagtcggaggttgcagtgagccgagatcacgccactgcactcctgcatggtgacagagtgagactccatctcaaaaaaaattttttttttaaatgatggagtcttgctgtgttgctcaggctggtcttgaacccctgacctcaaatgccgcctgcttcagcctaagtttcttttttttttgtaaagagacagggtcttgctatgttggccagggtagtctcaaactcctggcttcaagcagtcctcccaccttggcctctcaaagtgctgggattacaggcgtgaaccactacctataatgttgtgtttcactcaaggccttttgatttcgttttgcattaccgtgccacattgtgcatttccttgaccttttttgggttttttggagtgctttcatatgttaaaccatacctgattctcctcaaaatcacacaaagtagaatatcctaagacaagaaatctaaggaggcataaagaagttaactggttttattaaactcacacagtaaatgatagagccagaaatattccccttctagtgttcttcaccatcagcttaatgtagcataataattttctaattactgttgacaaataaataaccctttgaattttcaatactgggccttggataaattttcctaatttgtaagagagtattatcgtattgccatttacaaagctctcctgagtatctttttcttctgttaagtttacctaggagataaactgctgagtatggttgccattttggttttttgatataggttagaatgtcttggttttttttttttttttttttggtttttgttgttgtcattgtttgagacagcatcttgctctgtcgcccaggctggagtgcaatggcacgatcgtggctcactgcaacctccacctcccgggttcaagcaattctcctgcctcagcttcctgagtagctgggattacaggcatgtgcaaccacacctggctaatttttgtgtttttagtagagaaggggtttcaccatgttggtcaggctggtattgaactgctgacctcatgatccacctgcctcggcctcccaaagtgctgggattgcaggcatgagccactgcacctggctgaatgtcttgtttttgattaggcacttaagaaaggcctaggtactaaccataaaatatatttttataccttttgttgatactatatatatagaaaactgcacttatcataaccttagacaccttgaagaatgttcacaagcagaactaacccatgtgacccagcatccagatcaaaaacagcattatcagcccctctagaagccctcttgggccccttccattcactgtccttcttgtcaccagggtagctactatcctgacttttgatggcatagattagcattacctgttcttgtcattttataaataaaaccatactgtgtattcttttcttgtacagctttattgtgctaattcacatttacatcatacaattcagtggtttttatatggtcacagagttaggtaaccattaccacatcgattttagaacatttttttcactccagatagaaaccccctttacttaaactccaaatcccccactccaccagccctaggcagccactagtctactttttatctctatagagacaatagatttgcttattctggacatttcataaacatggaaccgtatattatgtggtcttttgttgccaactgtctttcacttagcatcatgtgttcaaaagagcatcatgttatccatgtttggcatgtatcagaattttattcctcattatggccaaatatcccattgcaaggatttatgacattttatttgaattgtaccctcctttctgccatttatcaataatgctactgtgaccatttgtgtacaagtttttgtgtggatacaggttttctttttgtttttaaatttgaggtggagtcttgctctgtcgcccaggctggagtgcagtggcacaatctcggctcactgcaacctctgtctcctgggttcaagcagttctcctgcctcagcctcccgagtatctgggactataggcacgcaccaccacgcccagctaattttttagtagagatggggtttcaccatgttggccagtctggtctcgaactcttgacctcaagtgatccacccatctcggcctcccaaagtgctgggattacaggggtgagccactatgcccggctgtggttttcatttcttttgttgtatatacataggagtagaattgctgagtcaagaggtaactcttaaacttattgaaaaactgccagattgttttccgaaaaggctgcaccattttgcaatcccaccagcagtgtatgagttttacagcttctccacatttcattggaacttattatctgtttggctgtttttaaaaatgatagtcattccaataagttctacttcagtgtggtttttgcacttctctgatgagtaatgatgttgagcatcttttcatttgcttattggcctttgttctagctttggaaaaatgtttattcaaatcctttggccatttttatttttatttttatttatttatttttttttgagaccaagtctcactctgtcagccaggctggagtacaatggtgtggtctcagctcactgcaacctccgcctcctgtgttcaagtgattctcctgcctcagcctcccgagtagctgggattacatttcaggcacctgccagcatgccgggctgatttttgtatttttactagtgacagggtttcaccatgttagccaggctggtcacaaactcctgacctcaggtgatctgcctgcctaggcttcccaaagtgctgggattacaggcgtgagccattgggcccagcctagattttcttttttctttttttttttgagaaggagtcttgctcttgttgcccaggctggagtgcaatggcacaatcttggctcactgcaacctctgcctcctgggttcaagcgattttcctgcctcagcctccccagtagctgggattacaggtgcctaccaccacacccagctaacttttgtattttttttagagacagggtttcaccatgttggccaggctggtctcaactcctgacctcaggtgatccacctgccttggcctcccgaagtgctgggattaccggcatgagctaccaggcccagccaattttctcattatattgcccaggctggtctcaaactcctgggttcaagtgatcctcctgccttggcctcccaaagtgtggggagtacaggcgtgagccaccttgctcagcccctttgcccatttttaaattagattgcctttttatattgagtttcaggagtcctttatatattctagataaatgtcccttatcaaattatattatttccaggtattttcttcattctgtgagttgtctttcctctaccttttaaaaaaggtgggtttttgtttgtttgtttgtttgtttttttaagataaggtctcattctgctgcccaggctggagtgcagtggcacaatcacagctcactgccacctcaacttcctgggccgaagtgatcctcttacttcagcctcctgaatagctagggccatagatacacactatcacacccagctttttttttctgtttgtagagacagatcttactgtgttgcccaagttggtctcaaactctaggctcaaagtgattctcccacctctgcctcccagagtgctgggattacaggtgtgagccacacgcaacctgtcttttcactattaatagtgtcttcctgcttcagcctcccgagtagctgggattacaggcacccaccaccatgcctggctaatttttttgcatttttagtagagacagtgtttcaccatgttcacccggctggtcttgaactcctgacctcaggtgattcacctgccatggcctcccaaagtgctgggattacaggcgtgagccactgcacccggccaaaatattgccttcttaacagtattgtcttctaatttgtgaacatggatgtatcttcatgtatttatgtgttctttcatttcagcagaattttgtagttttcagagtagaagcctttcacctccttgggtcatttattcctatgttttaagttcttttcgattccattataaatagaattgttttcttaatttcattttcagattgtttgatgagagagcatagaaatacaagtgatttttacatgttgatcttgcaacttcaactttgataaatctgattgttagctctaatagttttcttgtggattctttaggattttcaatatataagatcatgtcatttatggatagagatagttttttttctggctagaacttacagagcaatgatgagtagaagtggcagaagcaaaaatctttgtcttgtttcctatctgacagggaaagctttcagtttcatcatttaatatgatgttaggtgtgggttttcaataaatgccttttttcagattcaggaatttccctatcattcctgattttttaaggcttttttttttttttaaatcatgaaagggtgttgaatattgtcatgttctttctgtatcagtataaatgatcctatggattttgggttttattctgttgatgtgaaatattaattgattttcagatgttaaaccaaccttgcatacctgagatgaatctcacttggtcatggtgtataatcttttcaatatgctgctggattccatttactggtattttgttgaagattttgtatctgaacgcttaagataacatttacactctatcagaaatgaattgaccataaatgtgagagtgtatttgtgggttcttgattctcttccattccaaagatagacatacatccgtctgtatgtctgtctttatgccagtaccatactctcttgattactattgctttgtaataagttttgaaatcagaaagtataaatgagattttggtatctgagtaacagtcctcatagaattagttgggaaatattccctctttattctggtccctctttcttttttgtttaactgtgtatcttggagattgttccttctcaacacatgagagccgctttccctaccctcccacccctgctatagagaggtctataagtgtctgttcaattattttatttacttaacctattacttagtcggggacattaagcttgtttatgtcttttattttaaacaatgctgcagtgaataatcttgtatataagtcattttccatcaatataagtctctctgtaactgaatttttagaagtggaatttctaggtcaacctatggctctgtatttcacaaaaataccaattctggtttttcttgtggaggtggggagtaggaggtagaatgctggaggagaacttgctgtactcagctggctagtcattttagaaaggtttccttagcttctttttgtcatatggcctcaccaagaatcaaaaacattcctatttaccctgtaaacatggggctttactacccaagatacatatttctggatgtatgacagcttttcatattgaagaaataatgctgtgagtacagcacatttgttggaacttaggtcgttaagaatgtcttataaattcatacattatacattttattttattttattttttagtttttgatacagagtcttcctctgtcgcccaggccagcgtgcagtggtacaatcttggctcactgcgacctccatctcctgggctcaagtgattctcatgtctcagcctccagagtagctatggttacaggcatgcaccaccatgcccggctaatttttttatttttagtagaaactgggtttcaccatattgaccatgctggcctcgaactcttggcctcaagtgatcggcctgcctcagcctcccaaagtgctgggatccttgtattgggtaaaagatgaatattgagggctgcatggtggctcatacctgtaatcccagcactttctgagactgaggtgggaggagtcctggagcccaggagggtgaggctgcagtgagttgtgatcgcgccattgcacttcaacctaggaattataggcttcagtcactgtgcccggcatgtacattttaatattgtgctttcctcttttagctatagtatgaggttacatttcagagtcattgttgttaagcatcttaatagtgatgaggttgagtgaaagttacttctatttcaaacactgaagaaaattttgtacaaatctgtcacattccaagcccaggactgattgtttcatatacttctaattttacaatttctattgtagtccagtgtgaaaaaagccagtattaaaatactgaaaaattttgatgaagcgataattgtggatgcggcaagtctggatccagaatctttatatcaacggacatatgccgggtaagcttagctcatgcctagaatttttacaagtgtaaataactttgcatcttttaaattttttaattaaattttacatttttttctaatctattattatatgcccagaactttcacttagagtgtgcagtataatgtggtggttaagtataaaggctctggagtgacttcctgggttttaatcttggctctgccatttattggcagccgctaacctcttggtatctcagtttcttcatctgtaaaatgagaataataaagtgaaaagatgccaacatcatttactctgggctgcataactgatacttggaaaaagtattcctttgagtttaagaattaagttggttattcattttagcttgtaataaaaagatagtgattcataggatatgccacttactgaaatttaccacagatccaatcataaaatcactttctcttccctaaagatagcttgattaacatgtaaaggtgtgtaaaggcttgattacactaccctgatccgtaccccagttcccagcagcaccatgaaaaagggatttcaacatatttaattactttcagtagaaagtaacagtggtaggccaggcgcagtggctcacacctgtaatcccagcactttgggaggccgaggtgggcggatcacgaggtcaggagattgagaccatcctggctaacacgatgaaaccccgtctctactaaaaatacaaaaaattagccgggcatggtggcaggcacctgtagtcccagctacttgggaggctgagacaggagaatggcgtgagcccgggaggcggagcttgcagtgagcttagattgtgccactgcactccagcctgcgcagtggagcgagactcttgtctcaaaaaaaaagaaagtaacagtggtattgggagactgaggagcctagaaagtacttgaaggaagtaaaaggtttgtttgaccacattgtatttggaaagccagctttttcagctgtgtcagctttgtgtagtgatttttagttcttcttttagaaaataacggacaaggccgggcacggtggctcacgcctgtaatcccaccactttgggaggccgagacgggcggattacctgatctcaggagttcgagaccagcctgggcaacatggtgaaaccccgtctctactaaaatacaaaaagttagccgggcgtggtggcgtgtgcctgtagtcccagctactccggaggctgaggcaggagaattgcttgaacccgggaggcggaggttgcagtgagccaagatcacaccattgcactgcagcctgcgcgacagagtaagactctgtctcaaaaaataataataaaataaaaaagaatggacagtaaacctaaatgagttcattcccaaagatgatgttattcttaagggatggttcatttatttaagaccttacataaagtctatcaattgcgtgatttttcacttctgtaattgtgtgtatgtataatgtaaatatatatgtttttgttttgttttggttttttgagacggagtctcgctctgttgctcaggctggaatgcagtggtgcaatctcagctctctgcaacctctgtctcccaggttcaagcgtttcttctgcctcatcctcccaagtagctgggactacaggcacgtgccaccacgcccggctaattttttgtatttttagtagagatggggtttcaccgtgttagccaggatggtctcaatctcctgacctcgtgatccacccgccttggcttcccaaagtgttgctattacaggcatgagccaccacacccagcatgtattttttaaatgtataaaatgaagcagaaaagagaaatgataatttttcttcatcttgaaagattatcttcaccaggcgcagtggctcacacttgtaatcccagcactttgggaggcctcggcaggcggctcacttgagttcgaaaccagcctggccgacatggtgaaactccgtctctactaaaaataaataaataaagatggttttaatatatgttttagttttatgattttagcatctttctgaaatttttctcaaggcaagtaaatttgtatcagttggtatattggtacccatctatgaaataacttattaggaagatatctctaaaataagatcactttgcctaaaataaactgatatattgatgttcacagaatttttcttttaaccgacttgataaatgcattattcttgacgtcaagtgatccaccttcctcagcctcccaaagtgctgggattacacacatgagccaccgcacctggcattattcttataaaaggttaaatttctagttaagtttaatgtcctctttgttcatgtaccattgcttattttcttcccttcctactcacagtaatcattcttatggtatgcacttttgtttgcttatttttatgtaattgatattacgctccattctgtacgttgtactttcattcacagtgagttttggacattcctatgttcatctatacagacttacttcattttaactacactgtagtattccgtatgtaatatttactataactcatcactgtagcagagcatctcatagtgtatgtattactgttttgccattttggtatcaatgagtatttaagtcatttgcagtttttccctcttatacccagtattacagaggatctctttttatatgcttctttgtaccaagaggcagattaaaaaatttttttttgaaaaaatttttgaaaaaaaatgaaatgaagtctcactatgttgcccaggctggtctcaaactcctaggctcaagcaatccttccatcttggcctcccaaagtgctggggttacaggcatgagccaccatgcctggcctacattttaaattttgatagctcttacaatttactttgtaaagtatctgcatcattttatgttctcaccagtctttaataagaatacttcatacttttggctggacacagtggctcacgcctgtaatcccagcactttgggaggccgaggcgggcagatcaagagatcgagaccaccctggccaatatggtgaaaccctgtctctactaaaaatacaaaaattagctgggcgtggtggcgcacccgtagtcccagctactcgagaggctgagacaggagaatcacttgaacccgggaggtggaggttgcagtgaacttagatcacaccactgcactccagcctagcaacagagtgagactctgtctcaaaaaaaaaaaagaatacttcagacttaattttttttccagtcttaagtgtttgctaatgagattgagtttcttttggtatgtctcttgattgttcaggttttttcttttatgaattgactgttcatctctttttcacattatttctgttgggtgattttattagtgacttgttaaaattctgtatattttttcagcatgacacttcattattcaaaaaaaaaaaaagattctctatgtttctcgatactaatcattggttggtaataccttaaaaataagacccttactgtattttttgcttttttttttttttttttttttttttttttgagatagagtcttgctctgttgcccaggctggagtgcaatggtatgatctcggctctcagctcactgcaactgcaacctctacctccctgtttcaagcaattctcctgccttagcctcccaagtagctgggattacaggcatccaccaccacacccagctaatttttgtatttttagtagagacagggtttcaccatgttggccaggctggtctcaaactactggcctcaagtgatccgcctgcctcggcatcccaaagtactgggattacaggcatgagccacagtgcctagccactttttgctttttaactttgttttatagtactatagttttagtataaacagatgtatgtatacacacaactatggctttataatatgtttcagtcattgttagagcaaggcctaccttttgggtgcttcttttacaaaattgtcttggctattcttgtgccttttttcttatttgtgaattttagaattgtgaattacctgttgactcaccatgttttgtaaactgaggattttgaatggaattgcactcaattaaagattatcttgctttctgtgcagcaatgttttatttcaaataatccctactttaaattacttaggatagctataaattgtgtttctggctttctagatttagatgaaacgctttaaattgattgttttctcctaaatttaaaactgattgttagaagttaaagtcttctgttcattcttatttaggaagatgacatttggaagagtcagtgacttggggcaattcatccgagaatctgagcctgaacctgatgtaaggaaatcaaaaggtttgtggtgtttttatacttcatattaagcctttactcacattagtgattgactgtaagtcaaagaccacttaaggtttaaactgtttattttgtaaagtaaccactgtatctttcaccttgtgtttatagtcagaagtaagtacaagggcttcctgtagtcacatctttatgcaatctcctctgaatcaaaagttagtgaacttgctttgccactccagaaggcacatgaatatgaaaaagcattgtctattttcttatttaatggcaaaatacccgacctaagttggacttaatgtttgagaccgtttattttattaaattatattttttctcttttcttttttttttttgagacagttcttgctctgtcacccagaccggagtgcagtggtctgaccgcacctcactgcaacctctgcttcctaggttcaagcgattttcctgcctcatcctcctgagtagctgggactacaagtgcgcaccaccacacctggctaatttttgtatttttagcagagatgaggtttcaccacgttggctaggctggtctcatactcctgacctcaagcaatccatccgccttggcttcccaaagtgctgggattacaagtgtgagccaccatgcctggccttattaaattatttttattaaatttcctcaagattgatgaaagtaatgaaatataaaagtaatgaaatatatgtggaaaatagactggattaagaaaatgtggcacatatacaccatggatactatgcagccataaaaaaggatgagttcatgtcctttgtagggacatggatgaagctggaaaccatcattctgagcaaactgtctcaaggatagaaaaccaaacaccgcatgctctcactcataggtgggaattgaacaatgagaacacttggacacagggtggggaacatcacacgctggggcctgtcgtggggtggggggctgggggaggaatagcattaggagatatacctaatataaatgacgagttaatgggtgcagcacaccaacatggtacatgtatacatatgtaacaaagctgcacgttgtgcacatgtaccctagaacttaaagtataataaatttaaaaaaaataaatatatgtggaaaatattaataggtcaaaattcaaattgttcatttaatcagaagagtagtttagtcaaatccaagggttagacaacagaaatcttttttgtcaagtgcattctttgtgactgatttcattttcttcctggtttacacaggaagatttcagaaacaaatgtggatccgtgacagatggtatctagaagtttttagtttggttgaattgacagtattttattgagtaaaagatactaatttttgtaagaagaaaaattcaattttgataagtatgtttaagattaagagctattggccaggcgctgtggctcatgcctgtaatcctagcactttgggaagctggagcaggtgggtcacgaggtcaagagattgagaccatcctggccaacatggtgaaaccctgtctctactaaattagccaggcgtggtggcacatgcctgtgcacccgcctccgggtttaagcgatcctactgcctcaggctcctgagtagctgggattacaggcgccatggctaatttttgcatttttagtagagacagggtttcactacattggccaggctggtctggtctcaaactcctgacctcaggtgatctgcccgccttagcctcccaaagtgctgggattacaggcatgattcaccatgtctggccatttatcttattttcttttttttttttttttttgtttgagacggagtcttgctgtgtcgcccagagctggagtgcaatggtgcgatctcagctcactgcaacctctgcctcctgggttcaagcaattctcctgcctcagtcttccaagtagctgggattacaggcgcgtgccaccacatctagctaatttttgtatttttagtagagacagggtttcaccatgttggccaggctggtctcggaactcctgacctcgtaatctgcccacctcggcctcccaaagtgctgagattacaagtgtgagccactgtgcccagccatcttattttctttctttttttttgtcgggtgggagggggacagagtctagctctgtcgccaggcttggctcactgcaacctctgccccccaggttctagcaattattctgcctcagcctcccaagtagctgggattataggcacctgccaccacgcctggctaattttttgttatttttagtagagatggggttttgctatgttgaccatgctggcctcaagtgatccgcccaccttggcctcccaaagtactgggcttacaggcgtgagcttgtattgggtaaaagaacaatattgggggctgcatggtggttcatacctgtaatctgagcactttgtgagactgagatggaaggagtgttggagcccaggagggtgaggctgcggctgcagtgaattgtgatcacgccattgcacttccacctaggtaatggagcaagaccatgtctctaaaaaacaaaacacaatttttttaaggaatactgggaagaggtcagtggtggttttagaacagaggaagtgccagatgacctttgtgaggcattggccaggaagaactctacagtgtctttaggtagcttctgtccataaggataatggggtctcctccccagtattaatagaaaatctctgagctgtttttttttgtttgtttgttttgtttttttttcctgagatggagtctctctctgtcggccaggctggagtgctgtggcgcgatcttggctcactgcaagctctgcctcccaggttcacaccattctcctgcctcagcctcccaagtagctgggactacaggtgtccaccaccacgcccagctaattttttgttatttttagtagagatggggtttcaccatgtcagccaggatggtctcgatctcctgacctcgtgatccgctcgcctctgccttgcaaagtgctggagttacaggcgtgagccaccgtgcctggcctggtttttttgttgttgttatttatttatttatttatttattttttgagacagactctcgctctgtcgcccgggctggagtgtagtggcacgatgtcggctcactgcaagctctgcctgccaggttcaagccattctcctgcctcagcctcctgagtagcagggaccacaggcgctcgccaccacgcccggctaattttttgtatttttagaagagacggggtttcaccgcattagccaggatggtctcgatctcctgatgtcgtgatccgcccacctcggcctcccaaagtgctgggattacaggtgtgagccaccgtgcctggcctgatttttttttttttttaatctggtctcatacctctgacagctcatgaagaagtgctcctgcttcatatgtatatgtgttagcatagtgttaacatagcataggtgttcggtgtttgcagtttctgtttgttttatatgaattaaggtgtattatgagcagttgaagatatataggaaattttttcccaaaccactatctctgctcgttctattcattcagtctgtttatgttattccttcattcattcattttatagaacagtggagtgcctactgtatgcatctattgttctgggtcctggggaagaaaacaaagttcctgctttcatggaacttacattatattggcggagacagtaacagacaaacaaatgtagcctgtgtacatgtgttacatgaaaagcagggtagggggctgggagagagtagtagggagtgctattttcgaggtggttgtcaggaaaggcctcactgaggaggtggcattttgagtagacctgagcgcagcgggggcgtaagcccaggcagcatgtggaggaagagtgttcttggtgaaaggaacaaggatagaggcccgaagctagagagctcagcatgatcaaggaacagcaagccccgtgtggctggaatggagtgagcaaaggaatgagcagtagaaggtgagtgagttgggaggtcaccagagaccatggcaaggacttgaaagtgtcagggacacattggaagttggagcagggaaatgatgggatttatgttttgtttttgttttatgtttagtgtttttaagggattgctctatcagctatttggaaaatttagtgtagggcttcaagaagagaagcagagaaacaacattcttgccatagtcatagtctaagtaagggatgatggtggtgtggattaggctggtagtggaagaccagtccagttcgggttgtatttgaaggtagaggcaaaaagattatatttctaccagcaagcccatctatgaagttacttgtattattaatttaattgagacatgcccacataaactaataaataggaatttctgcagtttggttaaacacccctgtatatcctggttcttcttttagttgtccagatgtctctttaagtcaagtattttttggtggtgtaggagcctagagattgaatttattcacccaaaaggcatttgagtgattactatgtgccaggcactatgctgaatgccaaggatgtaaataagagggcgtagtctcagtctgttttactccagcttggttcctttttaatgaccctgacttgttaagcatatcagttatcctacagaatgtttaatcttctgtactttcctggttgtgttatttagcttatttctctttccttgacatttcttgtaaactggaagttacacctatagtcttgatgattcgtgttacacattttagattagaacacatcatgtgttgtatatggtgtttttgaaagcctctctgtatattggtctgtacattaaaatgttgcctgaatggatacacataaaatttaacagtgattacattagagatgagaagaaagaggtgccttttacttttcaatataccttttcctctgctttttgaactttcttgccctatgcatacgttattgcttaatcatccacctcatctcttcccctgtggctttctgttgcatttggaatgaaatctagcctctttgctgttacctgtggatgtcccttgctggcctctatcaccttactttgaaccactcctttcatggactgagctctcattggactatcttttattcttttgctgaagtttcttcactttgagtgcctctgcagttgctatttcatggctgtggcaagccctgccatggctttcatgcaaggatggttcctccttctcatctcaatattatctcttcagagagggaccttcccaactccgatgatctaaaatcctttgtatataccactcactaccacttctttcttttcttttccttttatcttttttttttttttttttttttgagatagggtcttgctctgttgcccaggctggaatcacgactcactgcagcctcatcttcttgggctcaaatgatcctctcacctcagcctctcgagtagctggaactgcaggcacacaccaccatacttggcttattattttactttttgtagagacagggtttcaccaaggctggtctcaagctcctgccgcaagcaatccacatctctcagcctcccaaagtattgggattataggagtgagccactactcctggcctattttcttattcactgtctaaaattatcttgttcatttatttacatacttgtttatagcttatttctcagctggacatggtgcctcacacctgtaatctcaatactttgggaggctgggttggagaattggttgagcccaggacttcaagaccagcctgggcaacaaagtgagaccctgtctataaaaaattgtttaaaaattagctgggcatggtggcacatgcctgtggtcccagctacttgggaggcagaggtgggagaatcgcttgggcccaggaggttgaggcgacggtgagccatgattgtgccactgcactctagcctagtgacagagtgagaccatgtgtctaaaaagtaaataaaaatagtttctctttcatgactagaatattacctctatgtgggcagggagtttgtctatactatttggcactatatttcctgattctgaaattatgcctagcacatggtaagtactccttaaatatttattgactgaattatttaatacttaagaatttcatttgggattatctgagtggtaagattacggattatatttatgtaagaaaaaatcattttttaaacttggttgccctttgccacactgacatagacactaagttttcttagccagattacttccgaggatactcacagaggccattctcttctcaatccccaaataattgatatttcttagcactttcaagctaatgcaattcttagatgatgtatctgtgtatatcatatcctcattctacaaatgtagaaattgaagtctgggcacagtggctctcacctgtaatctcagcagtttgggaggccaaggcgagcggatcactgaggacaagagttaagaccagcctggccaacatggtaaagccttgcctctattaaaaatacaacaattagggccgggcgtggtggctcacgcctataatcccagcacgttgggaggccaaggcaggcagatcacgaggtcaggagttcgagaccatcctggctaacacagtgaaaccccatctctactaaaaatacaaaaaattagccaggcatggtggcacgcgcttgtagtcccagctatcgggaggctgaggcaggtgaatcccttgaacccgggaggcggaggttgcaatgagctgagattgcaccgctgaactccagcctggtcaacagagggagactctgtctcaaaaaaaaaaaaaaaaaacaattagccaggcgtggtggcgggtacgagtacctgtaatcccagctactagggaggctgagggaggagaatcacttaaacccaggaggtggagtttgcagcgggctgataatgcaccactacattccagcctgggcaacagagtgagactctgtcttaaaaaaaaaaaaaagaaagaaagaaattgaggaatgtggagattgtggtctgtgatttgttaggaatcacacagcaggttagtagcaactacagggctttggttcagaataccaccttgacaatggtttgtttacagttcggctccccttcctctgcctttctctccttccttattgagggcagctggaaagaattttcatcatttactagcctatagctttaatttgagttttgaaaccttgataatagagcacagaggaaaagactgagttttctttttttgagacagtcttgctctatggcccaggctggagtgcagtgacaccatctcagctggttgcaacctctgcctcccaggttcaagcaattctgcctcagcctctcgagtagctgagattacaggcacgtgtcaccacgcccagctaattttctgtttttgtttcgttttgtttttttctgagatggagtcttgctctgtcacccaggctggagtgcagtggtgcgatgttggctcactcaaacctctgtctcctgggttcaagcaattcttctgcctcagcctccccagtagctgggactacaggtacgtgccaccatccctagttcatttttgtatgtttagtagagatggggtttcactatgttgaccaggctggtctcgaactcctgatctcaggtgatctactcgtctcagtttcccaaagtgctgggattattggcacacgcctatttttgtatttttagtagagacggggtttcaccatgttggttagactggtctcaaacttctgacctcaagtgatttgcccgccccagcctcccaaagtgctgggattacaggcgtgagccaccgtgcccagccaagattgagttttgaaaagagccttctgagattatgagaagggcaagcaagataacttaagaagttacattaaaatcatctaagagacagtgtaacaagaaggaattgtaaaatgatgttatgagcacgtgcccaatgtagtggcaatcccttgtgcttcgatacattggtgggagacaaaactgtacttaaattgataaatcccttacatgtcattttaaggagcttagactgactcccatcatgtagacatcagagatttcttttttttttttttttttttttttttttttttttgtgacagagttttgctcttgttgccgaggctggagtgcaatggcgtgatctcggctcaccacaacctccacctcccaggttcaagcaattctcctgcctcagcctcccgagtagctgggattacagccatgcaccaccacgcctggctaattttgtatttttagtagagacggggtttctccatgttgtggctggtctcgaactcctgacctcaggtgatcctcccgcctcagccacccaaagttctgaaattacaggcgtgagccaccgcgcccagcccagagatttctaaacagagttctaaccagatgcttttccctgtcagtagaatgagaatgaattggaggtgggagagactggcatgagggacaccagtcagccagtggaattagctggtaatgttgataggagaagaaaaagattcaaagttaggtagtggtagcaagaattagagggaaggtcggatttatgatatgtccaaggttgaattctaaggtgaaatttggtggcagatttcatgtgtaaattgggaaggtagattgagtttttttaacatgggttttctaacatgtcaatagagtgactctgcaggggggcctgacgagagaacagtgcatggggtgattcaacagccagttgagccttcatgcagagcatttaacactgtgactctgtagactctggttggcagtaaaatttcattaaaccaatatttaaacccttaggtaataataaaaattgagggaaaaggatccaggttttgtattttttatgaattcagttattgaattaaacaggaccttgcctcaagaaataatctaccaacaattaacttgttttaaagcaaagttaggaagtgagcatgttcaaattattaaataaaaaagtaagctgtgtatttcattcatagaaatagaggctggcctacttcggatgattctcagcatgtgattacagatgtgggcttatacatcctagggagttaaggcgtactctggcttggatagagtagagctctttgaaactcttctctcacccagctagtttatatagactagagaactagaatgtagcagcatactctgtcttagaagcccttttatataggagctggtctggaaggtttgaaaacataacaaatgtgttggtgtctcccaatgtattgctagattcttacccaagagcattatcctggttagggtttggtttggttttgttttgttttttaatgtttgccacaaactaacactagatgttagttctttcatcaagtgaggagagtagaagaaaagtccagaactctgaaacaccttttcaaaagtttttcaagccatgatgtttgcaagttaaatgctctgttatgtaagcaatataatcagtttttattaatgtaacattccttagtgttttggggtatcacacaaaaaagaatatccatatctggaagcaacagcttttaaataagagcattgtggtggtggtggtgatagtggtttttttttttttttttgagttggagtctcgctctgttgcccaggttggagtgcagtggcacgatctcagctcgcttcaacctctgctcccaggttcaagcaattcttctgcctcagcctcctgagtagctgggattataggcacctgctaccatgcctggctgatttttattattttagtagagacaggtttcaccatgttggccaggctggtcttgaactcttaacctcaggtgaatcacccacctcggcctcccaaagtgctggaattacaggcatgaaccaccatggccagccaaataagagcatttttaatgtaaaattatgcatgaaatgtacattcaattttgtctttgtttactaggatccatgttctcacaagctatgaagaaatgggtgcaaggaaatactgatgaggtaaatcctacctttaggataaaaagatttctgtttataagtgccaccctcatgtaagtgaggtttaaaattttccttttctttaggtcccatgtttaagcagcatggcacatttatgttctcttacccagaatgtaccaagaaagggtggtcccttcttaacatctaacaattgcctggtagtagcagtgaaggtatcttcagtcagaggctaggaccactgaaggatatacatgcattcaagtttccatcagccagcaggcatcagtaatcagtgtgtagatcaaaagctcaaatgtttccttccccactggcagttttacttcaagtagtggaggcttgcttttttaatagttaattaagtacattgagagatgggaggtgaaaaaaggaaaatgttttattttgaccatctaatatgaaagtagttcggtgttaggtatccagtagttgacactggaagacagggaatgacatgttaatattcatagccagagggtggcccaggttttttcgtacatgggaatgaaattcttatccaaataagtagaaattatgtgcgtaagccatttgttaagagcactgagtatgtgcatctcgatccatctaatgaataaccattatcaccagtttaaattattttctttaggcccaggaagagctagcttggaagattgctaaaatgatagtcagtgacattatgcagcaggctcagtatgatcaaccgttagagaaatctacaaaggtaaggatgacttcgttttgtgtaaactaaaaagtattattttccaggtgtaaaaataaaaaagaacataaggggtttctttgcctttgaaggattaactgctgtggggattaccttcttatcataagcaactagaaaattgacaaactaaatgaaacaactgtttgcatatattggacaatgggcaatacagggaaaccatggaaaccaaacagagcccagtagtcttgctgaacgaaagagttaaatatcaaagttcaggccaggtgcagtggctcacgcctgtaatcccagcactttgggaggccaaggcgggtgaatcacttgaggtcaggagttcaagaccagcctggccaacatggtgaaaccctgtcttagccgggtgtggtggcaggcacctgtaatcccaactatttgggaggctgaggcaggagaatcgcttgaaccagggaggcggaggttgcagtgagccgagatcacaccactgcactccagcctgggcgacgagcgaaaccccatttcaaaaaaaaaatcaaagttcagagagctcaatttgagtagaagttgtaggataaggtagcagaaaagaggaagctgcccagaaagaaagccgtagagatatttagagagattcccatggatccttggcctaggagtgatctgtatatgtgtggggtgaaaacgcatgtgtccaggtagagaaccccccagaaattagtaggctgaatgattgctggaacatagggctaagaaaagttcatggccagaaggatctggccagagtagagagacttagtaatacacaaggcattgggtagtgtcttcacagaggttatgccttactactgaagataaattagtcctagagtacaagcacctgaaccaagtttcaaagcaaatttttaaagggtcaaattacctaacaactgcatgccaaaacaaaggcctaaccctctttacagtaacacaacaaaattcagcacttcacagtgtaaagttagaatgtctgacgtccaggctgggcgcagtggctcatgcctgtaatcccagcactttgggaggccgaggcaggtagatgacctgaggtcaggagttcaagaccagcctggctaacatggtgcaaccccgtctctattaaaaatacaaaaacttagccaggcatggtggccggcacctgtgatcccggctacttgggaggctgaggcaggagaattgcctgaacccaggaggtgaaggttgcagtgagccgagatcgcaccactgcactctggtctgggcaaaaagagcaaaactcaggctcaaaaaaaaaaaagaatgtctgacgtcaatcacaaattaccaagcatgacatgaagttgacctataaccaggagaaaactcaatctatagaaacagacccagatgtgagaaagatgatgaatttagcagacaaagaccatcaagtggctattttaaatattaaaaatatgttcaagtggccaggtgcagtggctcatgcctgtaatcccagcactttgggaggccaaggtgggtaggagttcaagaccagcttggccaatatggtgaaaccccttctctactaaaaatacaaaaaaattagctgggcatggtggcaggtgcctatagtcccagctatatgggaggctgaggcacaagaatcacttgaacccgggaggtggaggttgaggttgcagtaagccgagattgtgccacttgtactccagcctggacaacagagtgagactctgtctcaaaaaaaaaaaaaaaaaagttaaagaaaacaagagtataatgagaaaaatgcaaaatagttttaaaagaaccaaatggaatttcttaaaataaaaaataccagaaatgggggccgggcgtggtagctcacgtctataatcccagcactttgtgggggctgaggcaggcagatcacctgagatcggtagttcaaggccagcctgaccaacatggagaaacctcatctctactaaaaatacaaaattagctgggcgtggtggcgcattgcctgtaatcccagctacttgggaggctgaggcaggagaattgcttgaacccgggaggcagaggttgcggtgagctgagattgcaccagtgcactccagcttgggccacaagagtgaaactccgtctcaaaaaaaaaacaaaaaaaaacagtagactcgaagaactagctgagtttttctttactttaggcagtaagtgtgaccttttgcaggtgactactttagttcctcatgtcctcattagtagatcagagaaattcgacaccaaaaccccaaaagaaaaaccccttctaatcctcattccatgattttatgaatgcatgaagtcctaggcctgcgaaggaatactcattctctttatcctgtgttgatacctctctgcttcaacctccaactcgacatttgcctataggatgtacttggacattcagcataaactacctcacaccattactgaattgcttcatgtgcacatgtcccatgccacaataccggggaccttgtcttccgtgatatttgtccgcagtgctgtgactacaggagggagtcagtgaatgtctgcatgtgtgtctttaccatccctcttgaatatgctctagggttaattcctagaagtagaattactctattgaaaattggcaatatttttcattctaatatctattgccaacatgggaaagcaagtctggatgccagtccttgttatatgccccttgggtaagttacgtaacctctttaagcttctgttcactcatattttaacaaggaaaattacaatattttacctcacaaaattgtagtcagcttctggctgtcttaaactctggtatatagtaaacactaagtgttggtgtccatccttaatttgtaataataggtcacttgttagagaaatgcaccttaccattttcttttcttttcttttttcagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaaaatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggcaactcttgctgcctctgcatgttttggaataacaatttctacaagactctaggctgtttaaactagtgctttcagttaagataaattctaatcatttctttgtatatacattttgtgcttctgagctagagatgccaagtagttgtaaactgcttataaagagaatagcagcaaatttgagactcggctacttttttctgccccacctgctttgagacacagaagcggagtgtggcccgaaattattagccagatttaatatttgatctaaagtaggtccttgtactcattttaaagttggaatttgattcctccaacattgagcacccaccatgttccaggctctgtgcattgtgcccacaaaataagattccctggtggagtttttatgggttcaaataatcagttgaacacccttcatctttatcatgttgttgacattgacacaaattgtttaaaaagaaaagatattagagagaaagtggtacctttgtaacttgatgtgtcttcatcattcggtaagatttgatgaaagtaaaaagcaaatgtcagccaaatccagtgaacagcaataaaacagggagtaactttttataactttttctacttggatttcaacattcagtagagcttttcgaaatgtaagtagtttacagtactggaggtttgactagttcagtaggaatttggaggggaaggtcattctgaattgtaacaaagtacaaacttctttgctgttttatttaagtactgagagctaagcacctgatgaagtgactgacctctctccagtgacagtgtttgggtacctgcctgacttcaggagtggggtttatgtttctacacagtgaccttttctctcgccctctcctccctcttgcccacacaccagttgattggacctgggttgaactcctgatccagacaggcccaagacagttcttaatgttaagaattttggggccgggcacggtggctcatgcctgtaattgcaacactttgggaggccgagacaggcggatcacttgaggtcaggggttcgaggccagcctggccaacatggtgaaaccctgtctttactaaaaatacaaaaattagctgggcatggtggcgcacgcctgtaatcccagctacgtgggtggctgagacaggggaatcgcttgaacctggaggcggaggttgtgcaatgagccgagaccgtgtcactgcattccagcctgggtgacagagggagactctgtctccaaaaataaaaataagaaaaagaattttgggctaggtgcagtggctcacgcctgtaattacagcattttggaaggcccaagatgggcagatcacttgaggacaggagttcgagaccagcctggacaacatggtgaaactccatctctactaaaaagacaaaagttagccagatgtggtgatgggcacctataatcctagctcctcgggaggctggggcaggagaatcacttgaacccaggaagcagagattgcagtgagccaagatcacatctctgcactccagcctgggcaacagagcaagactctgtctcaaaaaaaaaagaatttggccaggcgcagtggttcacgcctgtaatcccagcactttgggaggccaaggcaggcagatcacgaggtcaggagatcgagattgtcctggctaacatggtgaaaccctgtctctactaaaaatacaaaacattagccgggtgtggtggtgggcacctgtagtcccagctactagggaggctgaggcagaggaaggatgtgaacccaggaggcggagcttgcagtaagccaagatcgtgccactgcactacagtctgggcgacagagtgagactccgtctcaaaaaaaaaaagaattttggccgggtgcggtggcacatgcctgtagtcccagcactttgggagaccaaagtgggcggattacctgaggtcaggagttcaagaccagtccggccaatatggcgaaaccctgtctcttactaaaaaaaatacaaaaattagccaggtgtggtggcgggcacctggggaggctgaggcagggagaaatgcttgaaccggggaggcagaggttgcagtaagccaagatcgtgccactgcactccagagcaagactctttctcaaaaaaaaaaaaaaaagaattttgcatggggaaggagagatactgttcaccatctggaatggtgcttggatgtggcacttacaaaatcaggagccagcactgcatggacaaacagaagcatgtgggcctgagatagcaggtaccttgataaccctgaagacatccttggtttctgcatctattcctgcatccttgcattggactacattaatctgtcagttatccttataatgatttttgattttttttttttgagatggagtttcgctcttgttgcccaggctggagtgcaatggcacgatctcggctcaccacaacctccacctcccaggttcaagtgattctgctgcctcagcctcctgagtaactgggattacaggcatgcgccaccacacctggctaattttgtatttttagtagagacggggtttctccatgttggtcaggctggtctcgaactcccaacctcaggtgatcaccctgtctcggcctcccaaagtgctgggattacaggcgtaagccatggtacccggtctgttttttgattttttgaaaccagtctgaagtgagtttttttaattacgtgaaaggagtttggctaaaatactgccatactgccctaatgcctaatgattatgtattctcagcatgtctgcaaagtactgctgatttctggagaataatttttctttagtaaacttcacttaagtcgtcatgtgtattctctcaaaatggtatcctaacctaatggagctaaaagacaccccttgtttttataacaagcagttactgaggcccaggaaggggagaagtccctggcttgtgagatgatcaccattagaactcaggcctgggccagtgccttttcatgcttctcagatccttccaaagaataatgaagattataaccgcttttagcaattgtaataaacccagaaatagaaagctttttggttagagtactggtagaagtttggcgggagagataatttttacaaaatttgtaaatacctgccaattctatatactaggcaaggtctctggccttgtaaaacccctcaaggttacaactttggtggcccacactaatagttacccactgaggccctctccgggtgaacattgagcactagaggaagcccctctgcttgggcaggactgggcgtggtgcagagtaggagcggtgatactgtggattctgggcaggtggagatggccagtgatgtccaataaaggacactggagggagcagtgtgagtaaaggccctgagggcattcatgttcagggagggttgctgcccactggcttgcttggcacacaggagagtgggtattcctgccttagtaactttatgtaaacaagtatttcctcagtctgttcctctcaaactgcctgctctggcacattcagaatgtcacagaactcacctggatgcattcagccccttgcctaaaggtgacagtgcatctccttccccaccccacccctcataccactgaagcacctgtcagactggcccagtctgtgggcaaggagcctagagagggcttagtttcagcttgaaaggagctgggatttaccaagaagcaaatgagagacgaggattgcaacaactgtgccatttccccagcttcagctgactcctgtatattgactgtgccttcagactcatccgtaagtgaccccaggctggcctctcccacatcacagtaagaattccacacaccatacaacttggaaagaggctccagctgaaggaagccccacacttctttcaagtttttcttagtcttctcttcttggcaaagagtaccttttgtttcttctaattatgtaactattggtttagtaaatattcacccattcagtcaccctgtaagtggcaggcactgtttacagggacacaggaaggaataaaaacttgcaggcaccttggagcttgcattctattgaagaggtaatggaagttgggatagcagctaaactatgctggtattggccaggcgcagtggctcacacctgtaatcccagcactttggaggccaaggtgggcagatcatgaagtcaggagatcgagaccatcctggctaacatggtgaaaccccgtctctactaaaagtaaaaaaaaaaattagccaggtgtggtggcgggcgcctgtagtcccagctacttgggaggctgaggcaggagaatggtgtgaacccaggaggcgaagattgcagtgagccgagatggcaccactgcactccagcctgggtgacagagcgagactctgtctcagaaaaaaaaaatatgctggtagttttgattcaagatggcctttggagcccatgatttaggtctcgtacccaccaaggtctactggaaaacatcaggctctcctgctatagacccatagggagagctgcagccgagagggggagctgaagagaagtgccccttctgtgtcctgtcagcctcatccttccgcaaggaccagttgctgtgccactccattcacttgctgcaagactggaggtttttcctcaggtgttgagcacctggtttacaagatgtcagcatcttgatgcctgagaccatcaaggcaagtctctgaacagggcttaccttagagtaaggcttagaagaggccgtaaagtcagtctcagctccgtggctctgcagagctttgggacatgtgaattcttaaaaacaagactattgtacagttactatatgcatgcagtataaaattataaccttggaaaatcctagctagctgttgagctaattccataaagtaatcagctcctgagttctgcagtggtaataataatcagcataatgagtaaacactgtgtgtgccaggcagcgtctcatttgatccttgtgataatcttgtaagtactgattttctcccttctttaaacaaagttttttttttttttttagagagggtctcactatgttgcccaggctagtcttgaattc

SEQ ID NO: 15 - DNA, 18 bp, Artificial Sequence
  Primer
actgagcctgctgcataa

SEQ ID NO: 16 - DNA, 16 bp, Artificial Sequence
  Primer
ggcgcacgcctccacg

SEQ ID NO: 17 - DNA, 162025 bp, Homo Sapien
  misc_feature (0)...(0): Nucleotide sequence of chromosome 17 containing the genomic sequence of the predominate allele of the AKAP10 gene
gaattcctatttcaaaagaaacaaatgggccaagtatggtggctcatacctgtaatcccagcactttgggaggccgaggtgagtgggtcacttgaggtcaggagttccaggccagtctggccaacatggtgaaacactgtctctactaaaaatacaaaaattagccgggcgtggtggcgggcacctgtaatcccagctactcaggaggctgaggcaggagaattgcttgaacctgggagatggaggttgcagtgagccgagatcgcgccactgctctccagcctgggtggcagagtgagactctgtctcaaaaagaaacaaagaaataaatgaaacaattttgttcacatatatttcacaaatttgaaatgttaaaggtattatggtcactgatatcctgtttcattctttatataatcattaagtttgaaatgtatacttgcactactaacacagtagttaatcttagtcctacaagttactgcttttacacaatatattttcgtaatatgtatgcactggtgtttatgtacgtgtttatgtttatatctgttaaaattagcagtttccatctttttctattttgtaccatcacatcagttcagaaggattgacagagcaaaatgatttgatgaagtataaaagtcacatggtgagtggcataaatacaactctgaacaattaggaggctcactattgactggaactaaactgcaagccagaaagacacatatcctatatgtcaagagatgtaccacccaggcagttaaagaagggaagtacacatagaaagcacaatggtgaataattaaaaaattggaatttatcagacactggattcatttgctcctaaagtcagagtcctctattgtttttttgtttttgtgggtttctttttaaatttttttattttttgtagagtcggagtctcactgtgttacccgggctggtctagaactcctggcctcaaacaaacctcctgcctcagcttcccaaagcattgggattacagacatgagccactgagcccagcccagacgctttagcatttatgaagcttctgaaatagttgtagaaaccgcataagctttccatgtcactttcaaagtttgatggtctctttagtaaaccaaccaagttattcctcaagggcaaaataacatttctcagtgcaaaactgatgcacttcattaccaaaaggaaaagaccacaactatagaggcgtcattgaaagctgcactcttcagaggccaaaaaaaaaggtacaaacacatactaatggaacattctttagaagagccccaaagttaatgataaacattttcatcaaagagaaaagagaacaaggtgttagcaaattcctctatcaaataacactaaacatcaaggaacatcaatggcatgccatgtggaagaggaagtgctagctcatgtacaaaccagtagataatttcaacttgctgccgaatgaaacctctttgcaaggtatgaatcagcacttctcatgtttgttttgctttgttttgttttgtttttagagacaggcccttgctctgtcacacaggctggagtgcagtggcacgatcagagctcactgcaacctgaaactcctgggctcaagggatcctcctgccttagcctcccaagtagctgggactacaggcccaccatgcccagctaattttttaaattttctatagagatgggatctcactagcacctttcatgtttgatgttcatatacaacgaccaaggtacaatgtggaaaagggtctcagggatctaaagtgaaggaggaccagaaagaaaaggggttgctacatagagtagaagaagttgcacttcatgccagtctacaacactgctgttttcctcagagcagagttgatgatctaaatcaggggtccccaacccccagttcatagcctgttaggaaccgggccacacagcaggaggtgagcaataggcaagcgagcattaccacctgggcttcacctcccgtcagatcagtgatgtcattagattctcataggaccatgaaccctattgtgaactgagcatgcaagggatgtaggttttccgctctttatgagactctaatgccggaagatctgtcactgtcttccatcaccctgagatgggaacatctagttgcaggaaaacaacctcagggctcccattgattctatattacagtgagttgtatcattatttcattctatattacaatgtaataataatagaaataaaggcacaataggccaggcgtggtggctcacacctgtaatcccagcacttcgggaggccaaggcaggcggatcacgaggtcaggagatcgagaccatcctggctaaaacggtgaaaccccgtctactaaaaattcaaaaaaaaattagccgggtgtggtggtgggcacctgtagtcccagctactcgagaggctgaggcaggagaatggtgtgaacctgggaggcagagcttgaggtaagccgagatcacgccactgcactccagcctgggcgacagagcgatactctgtctcaaaaaaaaaaaaaaaaaaaaaagaaataaagtgaacaataaatgtaatgtggctgaatcattccaaaacaatccccccaccccagttcacggaaaaattctcccacaaaaccagtccctggtgccaaaaaggttggggaccgctaatctaaataatctaatcttcattcaatgctaaaaaatgaataaacttttttttaaatacacggtctcactttgttgcccaggctggagtacggtggcatgatcacagctcactgtagcctcaatcacccaggccccagcgatcctcccacctaaacttcctgagtagctgggactacaggcacgcaccaccatgcccagctaatttttaaattttttatagagatgggggtctcaccatgttgcccagactggtctcaaaccctgggctcaagtgatcctccctcaaactcctggactcaagtgatcctccttccttggcctcccaaagtgctgggattacaagcatgagccactgtacccagctggataaacattttaagtcgcactacagtcatggacaatcaggcttttcaacatgcagtatggacagtgagtcccagggtctgcttttccatactgaaatacatgtgatactaaggagaaaggtgctcgcaaggatatttaaaatgaagaatatttaaaatgaggaaaaaactgtttcttcatgactttgataaggctgataaagaccatttctgtgatctcaggtgattcactcaagtagtatatttcagtaatcattatctggaacagcctgaatcttaaccaaaataccatgattttttaatgctgttatgataccttgatgatatgaccaaactgcaatgtaggcagctaaatctccacgagtttgacttccccgagagttgacagttttcttcacaaattaaagaaatatattttttgatacatgattggcatatttaaaaactacactgaaatgctgcaaaatgatataaagaaacattttccagaatcaaatgcaatcaaagagtggattaggaatctactcaccattatcaactaaatagaaacacttggactgggtgtggtggctcacatctgtaatctcagcactttgggaggccaaggcaggtggattgcttgaggccaggagctcaagaccagcctgagcaacatagcaaaactctgtctctacaaaaaaaaaaaaaaattaaccaggcatggtggcagatgcttgtaatcccagctactctggaagctgaagtaggaggactgcttgagcccaggagatcaagactgcagtgagccgtggtcatgctgcgccacagcctgagtgacagagagagaccctgtctcaaaaacaaaaacaaacaaaaaacacttaaccttcctgttttttgctgttgttgttgttgtttgtttgttttgagatggagtctcactctgttgcccaggctggagtgcagtggcgtgatcttggctcactgcaagctctgcctcccgggttcacgccattctcctgcctcagcctcccgagtagctgggactataggcgcccgccaccacgcccggctacttttttgcatttttagtagagatggggtttcaccgtgttagccaggatggtcttgatctcctgacctcgtgatccacctgcctcggcctcccaaagtgctgggattacaggcatgagccaccgcacccggccaacctttctgttttttagtttgatatgcttgttaactcagcagctgaaagaatgctgaaagtggccttcagtaaaaaaatttcactagaatctctacatccatatttaatctgaatgcatatccagattgatcagttagagcaaaaacactcatcatcattcctgatgacctctaattctggtttcggctttctatttcaatggaaacagaataaggaaagaaatggaagggctctggaaatttgtcctgggctatagatactatcaaagatcaccaacaataagatctctcctataaatataaaacaagtataattaattttttaattatttttttctcttcagaggattttatttcaagataaaacataacttctacccatactattgattccaaaggttagaaaaagtgtttttcctcatcttatccttcaaagaggtcacagcaatgcaaacatctataaaatgcctctgcataattgtcagaagctatagtccagaaatcattgaaaatgcttttccattttaagcttaggtgaggtgtcttaggaaacctctatgacaacttactctatttattgggaggtaaactcccagactctcccagggtctcctgtattgatctcattttttaggcttcctaatcccttgaagcacaatcgaaaaagccctggatctcttttctgcacatatcatcgcggaattcattcggcttccagcaagctgacactccatgatacaagcggcctcgcccttctccggacgccagtccttgctgcggttagctaggatgaggggtttgctgggcttcagtgcaggcttctgcgggttcccaagccgcaccaggtggcctcacaggctggatgtcaccattgcacactgagctcctggcaggctgtaccaattttttaattatttaatatttatttttaaaattatggtgaatattttggtattctgctctaaaataggcccataaatgcacagcagatatctcttggaacccacagctttccactggaagaactaagtatttttcttttaaagatgctactaagtctctgaaaagtccagatcctctacctctttccatcccaaactaagacttggaatttatgagagatctagctaacagaaatcccagacacatcattggttcttcccagagtgcagtcctcctaaagaggctcagccctaagcaggcccctgcaccaggagggtgggtctgagacccacatagcacttcccaaggtgcatgctccagagaggcactgaaacagctgagcacaagcctgcaagcctggagaactctcacagtcagaacggagggggcccagtgggactaacataaagagaaaagggaacacagagaaatggatggcaccaacaaccagcaaagccttcatggccaatgaaagcatcagtgacggggccagaaccctcatccccaaagactcttcactgcctttagtgaaaaacaatggctagagagtgaagttatgatcatgtatagagaggtaaagttacatttttatattctgactctgctaatgtgaaattccctatctgctagactaaaagtttcagacaccctgttcaaatatcccattagttgctagagacttaaaatgaacagaacgcacattgtcaggatgactattaccaaaaaatcaaaagacagcaagtattggtgaggatgtagagaaactggaacttttgtgcactgtttatgagaatgtaaaatggagcagctgctgtggaaaagagtatgcaggttcctcaaagagtaaaaccaagatgtggaaacaactaaatgcccatcagtggatgaaggggtagacaatatgtggtatatacataccatggagtactattcagcctctaaaaaaaaaaaaggaaattctataacatgcaacagcatggatgaatcttgaggacattttgctaatgaaataaggcagtcatagaaagacaaatactgcacgactccacttatatgagataccaaaaatagacaaattcatagaatcaaagagtacaatggaggttacctggagctgcagggcgggaaacgaggagttactaatcaacgaacataacgttgcagttaagtaagatgaataagctctcaagatcagctgtacaacactgtacctagagtcaacaataatgtattgtacacttaaaaatttgttaagggtagattaacaaatgtagtagatccacaaatgtggttaagtgttcttaccacagtaaaataaaaaaagaatatcaagcccaggagttcgagactagcctgggtaacatggtgaaaccctgtctctacagaaaatacaaaaattagccagctgtggaggtgcactcctagggaggctgaggtgggaggcttgcttgagcccaggaggtcaaggctgcagtgagccatgattgcaccactgtactccagcccagatgacagagcaagacaccaccccccccaaaaaaagaaaaagaatatcaaacattttaaaagatcagatacgcaagaacaacaacaaaaaagagatgaacagagcatcgaccctcatctagtgggattcttggtctaactgaaaaacagacattgagagacaaacaatgacagtgatgtgatcacagcaattacacaggtatcccctggggactgcagaagaaaggaggaatgcctaactttcagaaaatagagaaagcgtcaaacagttggtgaaagccttccaaaactagagagaactgcacacaccaaatcacagaaagaagaaaagccgtgggagattctgggacccaccggctatttttgatggctgaacaccctgctgcaggagagacaggagctggaaagcatggtgggatgaaacctcaaacagctttgcctgcattgcttaagatgactgggcttgattaactctagtcaatggggacaattcaatcaaagaagaaagatgctcaaattcacattttagaatgattttttatggcagtatggggaatagattaaaagagagtgaagctggaggcaagaaacttgttaagaggcaactgaaacagtctagatgataaataataaactgacagagtgactagaaaaatcagaacaggctgaatcaacagatacctagatgaaaataacaggacttgatcaccagttgtatcttggagaggaaggagttgtttccttgctttccctacgactgggaatacggaaggtttgccgtgtgtattggttatatactggtgtgtagccaatcactgacaaccatttagcagcttaaaacacaaaggcttatctcccagtttctgtgggccaggaatctaagataggcttagctggctggttctggctcagagtttctcaagaggttgcaatcaagatgtcagctggggttgcatcatctgaaggctcaactggggccggagggtccacttccaaggagttcactcacctgcctgacaaggcagtgctggttgttggcaggagatctcaattcattgccaagtgagcctctctatagcattgctggaacatcctccccatctggcagttggcttctctcagcatgagtgatctgagagagagagcaaggaggaagccacagtgttcttcctactcctactcctaacactatggacctactcctaacactctcacttctgccttattccattagttagaaagggaactaagctccacctcttgaaataagaagtgtcaaagaatttgtggatatatttaaaaatcatcacactgtggaagtggatagggggttcaattaatgctgaacttgaaatgcctgagacattcaaatgtccaacaggcaatgaacatacccatagatggtcatgactttagcaagaatagaggaagatcacagaattaaggaggaattgaaaggtaaaagaagtggagtcagattccccctgaaaagtgagccatgaaaggaactttaactattgagttagaggtcagagtaggaaatttcggtggaattcttttttaaagaaaggaaccatataagcatgttttgaggtagagggagaataaatcagtagacagggagaggtaaaaaacataaatgataggggatagttgacaaaggtcttggcagaatcccttacccattgacttggggccaagagagggacacttctttgtttgagggataaggaaaataagaaagaatgggtgctatttagtgtggtcctgtctctagggcaaacgcataggtaacaaactgtgtgtgttaggaatatagatgtgacctcacattgagattctcacctcaaatccattttgttgttacctgtaccttcctaccttctctttttgctacatgcagactgctgttttgtcttcctggcctgttccaggtttcagcattctggcatatctgctaccctgttcccaaacctctctagagtccatgctccttccttggatagtgtttgattgggccacgtatctaagaagtgatgccttcagttaggcctgagaacctcctctatggaaatctccatcagtgaccctgacagacttggtatcttggagatgtcactgctcccagcctgtggtctaggagaatctcagcctgggcctctagtagtatggataaggcgttaaggtatctttgaaccagagtctgtcatattcctcaatgtgggacagataaaacagtggtagtgctggtgtttctgagctagaactctggtttttggtctagattctttgatgtatgacctttcagaggtattaaaatttgttctaatacaatgttcaatacaaatgtagttccttttctgttaggacctcaacaaaacatgaccaactgtagatgaacattaaactatgacaattcatggaaatgaatacagtaatacctgcggttcccccattttagcagtcactatggtgacatttggcacaaatggctatttaagggtgcttttgttaaaacctaccatcttactaggcacatgatattgaaactaatgaaataatggagaaacttcttaaaaacttttaatgaataaagtgatgaagtgataatattttagctgctatttataaagtgactattacaggtcaaacattcttctagggtttttttgttgaagttgtcacatttaatccttaataacccactatgagtcaggtattcttctctcccctttggacagttggggaaatgggggtcagagaggttaggtaatttgctcagggccacacaacctgcatgtagaaaatctgagatttgtacaggaacgtatcaaactctgaagtccatgcttctattttcccatgctgcctttctaataaaaggtaactaatgctactggatgctgcccccaaagtgagtcactttcaccccaccctacttgattttctccataaaactaatcacatcctgacaacttatttattgctgatctcccccactagattataaactcaataaaagcaagatccttgtctgctgaatatcagtacctaaaacgctgtctagcacagagcaagtaattaatatttgttgaatgaacaaataaaggaaaaaaattcaaaggaagaaaaagccctaaaacagatgtttacctaaacatacattttaaaagaaagcatataacaaattcaggacagaatttaaatttgattttttaaagaaataaccaagtgctagctgggcacagtggctcacacctgtaatcctagcactctgggaggccgaggcaggcagatcacttgaggtcaagagttcaagaccagcctggccaacatggtgaaacctgtctctactaaaaatacagaaattatccaggcatggtggcaggtccctgtaaccccagctactcaggaggctgagtcaggagaattgcttgaacccaggaggcagaggttgcagtgggccaagattgcaccactgcactccagcctgagtaacaaagcaagactctgtctgaaggagaaggaaagaaagaaggaaagaaggaaagaaggaaagaaggaaagaaggaaagaaagaaagaaagaaagaaagaaagaaagaaagaaagaaagaaagaaagaaagaaagaaagaaagaaaaagaaagaaagaaagaaagaaccaagtgcttatttgggacctactatgctatgtttttccatgcacgctattttcagtaaagcagttagcaaacttgcaagatcataacaacaaatatatgcttctataactctaaaattgtgctttaagaagttcctctttaccagctcatgtatgcattagttttctaagagttactagtaactttttccctggagaatatccacagccagtttatttaaccaaaggaggatgcttactaacatgaagttatcaaatgtgagcctaagttgggccagttcatgttaatatactccagaacaaaaaccatcctactgtcctctgacaattttacctgaaaattcattttccacattaccaaggagccagggtaggagaatatagaaagaccacccaagaatccttacttctttcagcaaaatcaattcaaagtaggtaactaaacacatgccctaacaatgaatagcagattgtgctcagaagaatgatctacaacatcttactgtgaaggaactactgaaatattccaataagacttctctccaaaatgattttattgaatttgcattttaaaaaatattttaagcctaaattttaaaaggtttgatattggtacatgaatagacaaacagacatggactagaccaagaattaggttcaaacatatacaggaatttaatatacgataaatctagtattccaaaggaaccaacaaatggtgttcagacagcaggataggcatcaggaaaaacacagttgggcaccctaccttactcctaacaccaggagtaactgaaggagcaccaaatatttatttattttaattatagttttaagttctagggtacgtgtgcacaacatgcaggtttattacataggtatacatgtgccatgttggtgaggagcaccaaatatttaaaagaaaaaaattggccaggggcggtggctcacacctgtaatcccagcactttgggaggccaaggtgggcagatcacctgaggtcgggagttcgagaccagcctgagcaacatggagaaaccccatctctactaaaaatacaaaattagccaggcatggtggcacatgcctgtaatcccagctacttgggaggctgaggcaggagaatagctttaatctgggaggcacaggttgcggtgagctgagatattgcactccagcctgggcaacaagagcaaaacttcaactcaaaaaaattaataaataaataaaaataaagaaagaaaagaaaaaaatgaaaatagtataattagcagaagaaaacaccgtagaatcctcggactcttaggatggggaatgcctataatataaaaaccctgaagttataaaagagaaaatcacctacatacaaaccaaatctttctacatgcctaaaacatagcacaaacacagctaaataatcatagctgaatgaactgggaaaacaaaacttgactcatatccagacagagttaattttcctacacataaagagtacctatataaacccaacaaaaaaaccaccactaacccaaaataaaaatgtgacaggtaatgaacaggtagttcacagagaatacaaatggctcttcggcacataagatgctcagactgacttttacttatttattttttgagagacagggtctcacgatgttgcccaggttaggctcaaactcctgggctcaaatgatagtaccaggactacaggtgtgccccaccgcacctggctcctcaaccacctgtattaacaggaaatgcaaaataaaactttcaaatctattttacctattagaatggcaaaaatttgaaaaacttcaaacatcatcatgttggtgagaatgtgaggagactggcactctcattttttgctgatagcatatatatactgatggcttctatggaaagcaatctggcagcgtctatcaaatgtacaagtgcatatatcctttgacaaagcaattccactctaggaatgtgttctatatggttgtgcttcctggggctgggaactgggagctaagggacaggggcagaagataatcttcttttccctccttccccgttaaacatgttgaattttatatactgtaatatattatttttcacaaaagataatttttaagcgatatgtctgggaatttttttttttcttttctgagacagggtctcactctgtcatccaggctggaatgccatggtatgatctcagctgactgcagcctcgacctcctgggttcaagcaatcctcccacctcagcctcctgagtagctgggactacaggcacgtgccatcatgctaatttttgtatatacagggtctcactatgttgcccaggctaatgtcaaactcctaggctcaagcaatccacccacctcaggctccaaagtgctgggattacaggcgtgagccaccgcgcctggccctgggaattcttacaaaagaaaaaatatctactctccccttctattaaagtcaaaacagagaaggaaattcaacctataatgaaagtagagaagggcctcaaccctgagcaacaaacacaaaggctatttctgagacaggaatttgctgaacaaaatcgagggaagatgacaagaatcaagactcacttctcggctgggcgcagtggctcacacctgtaatcccagcactttgggaggccgaggcggacagatcacgaggtcaggagattgagaccatactggctaacacagtgaaacccagtctctactaaaaatacaaaaaattagccgggcgtggtggcaggtgcctgtagtcccagctacttgggaagctgaggcaggagaatggcgtgaacccaggaagcggagcttgcagtgagccgagatcacgccactgcactccagcctgggtgacagagcaagactctgtctcaaaaaaaaaaaaaaagactcatttctctagatcttgagccgtattcaaatttatctcagcttagtgagaggttaaagcaaggaatatccttccctgtgggccctgctccttactgaaggaaggtaacggatgagtcaaggacaccaatggagaaaagcactaacaccattatctgatgaacattacgtgaagaagggtaagaagtgaagtggaattgctgaagaagtcagtgaaagcggacattcatttggggaaatggaatataggaaatccataaaagtgattaaaaagatgttagaggctgaggcggggggaccacagggtcaggagatcgagaccatcctggctaacacggtgaaaccccatctctactaaaaatacaaaaaattagccaggcgtggtggcaggcacctgtagtcccaactactcgggagactgaggcaggagaatggcatgaacctgggagacggagcttgcagtgagccgagatcacgccactgcactccagcctgggtgacagagtgagactccatctcaaaaaaaaaagttagatacgagagataaagatccaacagacacacaactgctaattctgaacagaacaaaacaaatggcacaggaaaagaaaatttaagatataacaccggaaaactttcctgaaattgagtaactgaatctatagcttgaaagggtttagcatatgccaagaaaaatcagtagagtccaaccagcacaagacacatctagcaaggctggtgattctaccaacacagagaaagaagtgggtgacccataatgcggaaaaaggcagaccatctgcagtcttctccagaacactggagtctgaagacaaaagaatgctgcctactgagccagaagggagagaaagtgacccaacacatctttaccaagttagaatgtcacgcattatttaaaggctgcaaaagccatgaaagacatgaaagaacacaagcatttacaacatgaaagaacacaagcattctcatactcaagaatccttaagaaaaatgtagtcctaatccagcccactgaaagttaaatgtacttaatgtgctcattaatgggaacttcatagcttcaaatcagtctggtcccatctaccaacatctctcgcccggctttcctgcaatagtcagcacctttccctcctcccagtcttgtcccctggagtctgctctcagcatagcagagtgaccacatcaacacccaagtcagagccctccagtgcgcactggtctacaaagcccttcccaccccccaccccacgtgccctccggatccttgtgacgtgtctcctgcataccctagcagccctggcctcctcactgcccctcctgtacatcaggaaggcgactccttgagtcttggctctggccgcctcctccacctgcagtgagttaactcccttacctactctaggtcattgctcaaatgtcagcatctcaatggggccctccctgactaccctatttaaattctacatactccccttgaccccatggacctcactcaccctattccacttttattcttacaatttagcacttgttctcttctaacgtattctaagacttactcatttattacattgtttgccaccccctctagtacataaactccagaggggcagggatttctgtctatttattcatttctttatccctaggacatagaacagggcatagttcagagtattcaatgttatcaatgaatgaactagcagtagtaccagttccagttaggcacagaattaaatctaaatagaattaaatctcatggtctgggttaactatggatagaaaattagatataattttaagaagcctagaaagaaaaaattaataatgtaaaaataatattaatttgataataataacaaaaactctgccaggcactgtggctcaaatctgcaatcccagctactcaggaggctgaggtggaaggatcacttgagaccagagttcaagactcagcctaggcaacacggcaagaaactgtctctaaaaaaattaaaacttaaatttttaaaaaagaattctcaaagcgtcacaaaaactggagattaaggtacaggaagtgtgaagtaatattactatgctaatggttttttttttttttagaaaggtataaccaaaagatttctttctcaagtcgataaactgagaaagataagcatatcttccaattaacagagggggaggaaaagccagatacaacaaaataagatataaattagtttccagttgaaaacaagagtaggagttattttgcatcacctcacctgtgacctcccccagcccaaaaaacactactgataaacagggtagaaaagcatcatctcagataaagcaggaaaaactgccacagtctcaaaccacaaactataagcacacacctggccaaccctgccaagtctgggctcagtaggaggaacgtgctgagagctaggatgtaccaacttagacattctgtgggatacagatgtccctggaagggtcacaccatctcaaaggcacctgtaatgcccactgattacagccaccatatgtgagagagaaactcagggcacttagagagtataacaagaaccttatgtcatctgagatgaggaatcctcagccctgcaaattaaccaactctttagaacaactggcaaaacataaatatccacaacttttgtttcagtaattccactcttagatatcaatccaaagtacatgagacagcagatacacacacaaaatggtatttactgcagcattgtttataatagcaaaaaacaagaaataatccatatgtctcaataggatactgggtacatgagggtatgtacccatcattcaaccatcaaaaagagtgatatggatgtccacagatggacataaaaagctgtgtgttacgtgaaaacaaactcaagcagcagcaggatgggcttatgatagtcagtatgagctaatttctggaaaaaaaaatctagtgtgtgcacagaaaacatctgaaagaacagaaacaaaactatcagcagaatattgagatgttttactaagttgtatatctatactgcttgtaatttttaccccaagcaagaattactttttggaaaaagaaaattcaggaaataaagcatttctttaaacttcatgtttaaacaaatggtgatggaataaaagagttcttattcatcataaacacacacagcacacatgcacgcatgtgcgtgagcacaccctttacttgataaataccatgttgaatattttagtctttccttttaggttctatcccttcactcaaaatgcggttataaataaatgtacttttcatgtgccttctgcctaaacccactttaatataactttacagtcccattatcattatagtctcaaagctagactcagcctgaaactaccctttcatttggaacccttattaaaatgccacatacagctccttcaaataaaaacaaaccctaggacctgacactaggcttcctttgttgctactcataatggccaagttctgtgcttataatacatcttctttcattttattgctacatatccaagggttttatatgtttttcttattatatcttaattcaaaacaccatcacgctcttttccagatgaaaataaggaaaagaaattgagcaactgactgacttaaaggtcataaaactatatagtagcagagtcagcaaaagaagaaacacacatctcccaagtagaggctgaaaaccagtaccattcacctccagggtgagctatatacagattacaaagtcaccttctctaaatgttcaaactgaatcccatacccatactttaccactacctcgtaagaacagcctcagatcttgttatagccttttttttagcatgctgaagccaataaaatgcttcccattcagcaagagaaacaagttctgaaacactgaataatctgcccagggcctatgaacatttccactgtgagaaatgttctccactgtgtggagaagatccttactcttctccacacaggcagaacattagaaaaattcttggattctatgatgcacagcttaggagtctgtttagcacaatttaagtccaaatagttattaaatcctcctctgttccagaaacagtgctaaatactgtgaatataaaaattgaaaagatactctcctggctcccaagaaagtcagccagatagaggagacacaggcacacaaatcactgtcacatgaagctctacctccctaacttcaaacgagggcctaagtcaccaagaatacagtagcagttgtgactacgagtaactactataattcaatactttatcttcccttagaaaactcttctcccttggaaatttatttgcatttctaaataccattccttactaaaaggaagcagggctccttggggaaatagctgattctaggtgtggactatgaaatgaaaatggtgagtctgggacatcccatgttgcccagaaatcaaggaactgcccaaagattaacagagtcatgttaaatggacctaagagtgaaccagaaggagctcactttgccccgcgtggaacaatttcaagaaaaacatgacagtaatgaattataaaacatgaattaaaatacatattggtactaaaaagagaacaaaaggatgtggctttggataaagctcttcttcatggaagaataccagctaataaatgtaaaggaaatgagagaattagaaaaattatcattttgtaaaccttaatatattcacctagacatgctaaaaccactgagtaaaaggctgcttgggaagaggatgctcacatgatctcagagtttcacaccacagataatttattagatacaggaaggaagatgtgatcaagcttcctgtgacccccagccaggccccacaacactatgtgcctccttgtgatgtgggagctacacagcatcgcccacacagcttctcgccaaaactgtttgaagctaatcacaagggaagaactggacagcttctgaccatgagacgctccaccagacaacttgcttggcctctccaaagaaacttgcttggcctctccaaagaaaactcagtttcatttaaaaacaaaactaattatttaaaaacaaacgaaaagcaagttgtggacttgagctccagggacagagcagacatacttttccctgttcttcccagtaagtggtaataaaaaccctcaacactagatataaaacaaatataagaaggttctggaaggggaagaggaggcagactatccaggtgccttgaggcccacagaacaacccagtgatgggttcactgggtcttctttttgcttcattatctcagacttggagctgaagcagcaggcaacttcaaaacaccaaggggcacagattgaaaagccccaagaaaagcctgccctctctagccaaaggaccaggaaggagacagtctaatgagatggaacacatttagacagtaactgcccatttaccagcaataactgagcagggagcctagacttccagtcttgtgaggacgtaccaaggtacccaacacccccaccaaggctgagtaaggactgcgacttttatccctgcatggcagtagtaaggagcccatccctcacccgccagcagtgtcaggggaacctggacttccactcccacccaggagtgatgaggccctccctgctggggtcatgtcagaggaggcctagtggagattcagtgacttaaccttttcccagagataatgaggccacctttcctccctcttcccccatggtgacagtgaaagcactgtggcaagcagtaggcactcctacccctcctagccagggaggtatcagggaggccaagtagggaaccagaatacccacaaccacccagcagcaacaggggtcccccaccccattgggtgtcaatggaagcagagcggaaagcctggatatttacccccatctagaagtaacaagctgatgtcccccttcttctactacaatggtgttcaaaacaggtttaaataaggtctagagtctgataacgtaatacccaaatcgttgaagttttcattgaggatcatttataccaagagtcaggaagatcccaaactgaaagagagaaaagacaattgacagacactagcactaagagagcacagatattagaactacctgaaaggatgttaaagcacatatcataagcctcaacaggctgggcgcggtggctcacgcctgtaaccccagcactttgggaggccgaggcaggtggatcacaagatcaggagatcgagaccatcctggctaacacggtgaaaccccgtctctactaaaaatacaaaaaaaaatagcaaggcatggtggtgggcacctgtagtcccagctactcgggagcctgaggcaggagaatggcatgaacctgggaagaggagcagtgagccgagatcgcaccaccgcactccagcctgggcaacagagcaagacttcgtcccaaaaaaaaaaaaaaaaaaaaaaaaagcctcaacaaacaactacaaacgtgcttgaaacaaatgaaaaaaaaatcttggcaaagaaataaaagatatatattttggccaggtgcagtggctcacagcctgtaatccctgcactttgggaggctgaggcaggcggatcacctgaggtcaggagtttgagaccagcctgaccaacatggagaaaccccgtctctactaaaaatacaaaattagccagtcatggtggcacatgcctgtaatcctagctactcaggaggccgaggcaggagaatcgcttgaactcaggaggtggaggttgcggtgagccgagatcccgccattgcacattgcactccagcctgggcaacaagagcaaaactccatctcaaaaaaatagatacatattttaatggaaattttagaattgaaaaatacagtaaccaaattgaatggaaagacaacatagaatggagggggcagacaaaataatcagtgaacttcaacagaaaataatagaaattacccaatatgaagaacagaaagaaaatagactggccaaaaaataaagaagaaaaaagaggagcagcaggaggaatgatggaaaaagagaaaggaaggaaggaagggaaggagggagggaaggagtgagggagaaagtctcaaagacctctgagactaaaataaaagatctaacacttgtcatcagggtccaggaaagagacaaagatggcacagctggaaacgtattcaaaaaataatagctgaaaacttcccaaatttggcaagagacataaacctatagattcgaaatgctgaaccccaaataaaaagcccaataaaatccacaccaaaatacatcatagtcaaacttctgaaaagacgaaaagagaaaacgtcttgaaagcagtgagtgaaacaacacttcatgtataagggaaaaacaattcaagtaacagatttcttacagaaattaaggaagccagaaggaaatgacacaatggttttcaagtgctgaaagaaaagaagtgtcaacacaaaattctagattcagtaaaaatatccttcaagaatcaatgggaaatcaagacagtctcagataaagcaaaataagagaatatgttgccagcagatctcccctaaaggaatggcaaaaggaagatcatgcaacagaccaaaaaatgatgaaagaaggaatccagaaacatcaagaagaaagaaataacatagtaagcaaaaatacatgtaattacaataaaatttctatctcctcttaagacttctaaattatattgatggttgaagcaaaaattataaccctgtctgaagtgcttctactaaatgtatgcagagaattataaatggggaaagtataggtttctatacctcattgaagtggtaaaatgacaacactgtgaaaagttacatacacacacacacgtaagtatatataaatatatgtgtgtatatgtgtgtgtatatatatatatacatataatgtaatacagcaaccactaacaacactatacaaagagataataaccaaaaacaatttagataaattgaaatggaattctaaaaaatattcaaatactctacaggaagacaagacaaaaagagaaaaaaagaggaggacaaactaaattttttaaaaacataaataaaatggtagacttaagccctaacttatcaataattacataaatgtaaatgatctaattatatcaattaaaagacagagatagcagagttaatttaaaaacatagctataagaaacctgctttgggctgagtgcagtgactcacacttgtaatcccagcacttcgggaggccaaggcgggtggatcacctgaggtcaggagttccagaccagcctggacaacatggtaataccccatctctactaaaaatacaaaaaaattagccaggcatggtggcacacgcctgtagtcccaactactcaggaggctgcgacacaagaactgcttgaacccgggcagcagaggtagcagtgggccaagattgcgccactccagcctgaacgacagagtgagactccacctcagttgaaaaacaaaaaagaaacctgctttaaatataccaacatatgttggttgaaattaaaagaataaaatatatcatgaaaacattaatcaaaagaaaggagtggctatattaataacataaaatagacttcagagaaaagaaaatttcaagagacaggaataaaaggatcaagaaaagatcctgaaagaaaagcaggcaaatcaatcattctgcttggagattcaacaccctctcttaacaactgatagaacaactagacaaaaaaatcagcatggagttgagaagaacttaacaccactgaacaacaggatctaatagacatttacggaacactctacccaacaatagcaaaataaacattcttttcaagtattcactgaacatatccttagaccctaccctgggccataaaacaaagctcactagtgattgccgaaggcttggatggacagtggaagagctgcatggggagggagaaggtgacagttaaagagtgtaggatttctttttgggataatgaaaatgttccaaaattgattgtggtgatgttggcgcaactctacaaatataaaaaaggccattgaattgtacgttttaagtgggtgaaacatatggtatgtggattatatctaacgctttttaaaaacttaacacatttcaaagaatagaagtcatacagagtgtgctctactggaatcaaactagaaagaggtaactggaggataacgagaaaagcctccaaatacttgaaaactggacagcacatttctaaaatcatccgtgggtcaaagatattcatttctgatattcatttttattgtttaatgtatttttaaaaatttcttaagggaaataaactgactaaaaatgaatatggctgggtgcggtggctcacgcctgtgatcccagcactttgggaggccgaggctggtggatcacaagatcaggagttcgagaccagcctggccaagatggtgaaaccccgtctcaactaaaaaactacaaaaagtagccaagcgcagtggcgggagcctgtggtcccagctacttgggaggctgaggtaggagaatcgcttgaacacaggcagcagaggttgcagtgagccaagattgtgccactgcacgccagcctgggcgacagagactgcctcaaaaaaaaaaaaaaaaaaaagaatatcaaaatttgtgggacatagttaaagcaatgctgagagggaaatttataacactaaatgtttacattagaaaagagaaaaagtttcaaatcaatagtctccactcccatctcaagaacacagaagatgaagagcaaaataaacccaaagcaagcaaaagaaagaaaatataaaaataaatcagtaaaattgaaaacagaaacacaataaagaaaatcagtgaaacaaagtactgattcttcgaaagattaataaaattgacaaacctctagcaaggctaacaaacaaaaaagaaagaagacacggattaccagttattagaatgaaagcataattagaaacaactctacacattataaatttgacaatgtagatgaaatggactaattactgaaaaaacacaaattaccacaactcacccaatatgaaatagataattgggatagcctgataactactgagaaaattgaatttgtaattttaacactcttaaaacagaaacattaaacttaatattttataaatattagataaggtaattatacccttccttaacaaataaaaacgacaaattattttgcagctaaagagatgtatgtactgtgaaaaatatcttcagaaaaatagaactttgtttgaagaataaggatttaaaaaatgtttttaactctcaagaagcaaatatctgggcccagatggtttcactgaagaattctaccaaatgtttaatgaagaattaccaccaactctacatagcatctttgagaaaactgaagagaagggaacatctcccagttcattttatgaagtgggtgttactctgatactagaactgtataaggacagctactcttgacacactgcctatgggtagctctgctctgcaggaacagtcagaaaaaaaaaaaaaagaagcactggacaagggcagtataaaaaaagaaaactgggccaggtgcagtggctcacacctgtaatctcagcactttgggaggctgacgctggtggatcacctgaggtcaggagtttgagactagcctggccaacatggtaaaaccctgtctctactaaaatacaaaaattagccaggcagggtggtggggaaaataaaaaggaaaaaaaaacaaaaataaactgcagaccaatatccttcatgagtatagacacaaaactccttaaactccttaacaaaatattagcaagtagaagcaatatataaaaataattatacaccatgatcaagtgggacttattccagaaacgcaagtctggttcaacatttgaaaacaaggtaacccactatatgaacgtactaaagaggaaaactacataatcacatcaatcaatgcagaaaaaagcatttgccaaaatccaatatccattcatgatactctaataagaaaaataagaataaaggggaaattccttgacttgataaagcttacaaaagactacaaaagcttacagctaacctatacttaatggtgaaaaactaaatgctttcccctacgatcaggaacaaagcaaggatgttcactctcattgctcttatttaacatagccctgaagttctaacttgtgcaaaacgataagaaagggaaatgaaagacctgcagattggcaaagaagaaataaaactgttcctgtttgcagatgacatgattgtctcatagaaaatgtaaagcaactaggggtaggggggcagtggagacacgctggtcaaaggataccaaatttcagttaggaggagtaagttcaagatacctattgcacaacatggtaactatacttaatatattgtattcttgaaaatactaaaagagtgggtgttaagcgttctcaccacaaaaatgataactatgtgaagtaatgcatacgttaattagcacaacgtatattactccaaaacatcatgttgtacatgataaatacacacaattttatctgtcagtttaaaaacacatgattttggccaggcacagtggctcatacctgtaatcccagcattttaggaggctgaggcgagcagaaaacttgaggtcgggagtttgagaccagaatggtcaacatagtgaaatcccgtctccactaataatacaaaaattagcaggatgtggtggcgtgcacctgtagacccagctacttgggaggctgaggcacgagaattgcttgaacaagggaggcagaggttgcagtgagctgggtgccactgcattccagcctggtgacagagtgagactccatctcaaaaaaaataaaataaagcatgacttttcttaaatgcaaagcagccaagcgcagtggctcatgcctgtaatcccaccactttgggaggccgaggcaggcagatcacaaggtcaggagtttgagaccagcctgaccaacatggtgaaaccccatctctactaaaaaatatataaattagccaggcatgtgtagtctcagctactcaggaggctgaggcaggagaatcacttgaacccggaggcagaggttgcagtgttgagccaccgcactccagcctgggtgagagaacgagactccgtctcaaaaaaaaaaagcaaaataacctaattttaaaaacactaaaactactaagtgaattcagtaagtctttaggattcaggatatatgatgaacatacaaaaatcaattgagctggacaaaggaggattgttttaggtcagtagtttgaggctgtaatgcacaatgattgtgcctgtgaatagctgctgtgctccagcctgagcagcataatgagaccacatctctatttaaaaaaaaaaaaattgtatctctatgtactagcaataagcacatgggtactaaaattaaaaacataataaatactgtttttaattgcctgaaaaaaatgaaatacttacatataaatctaacaaaatgtgcaggacttgtgtgctgaaaactacaaaacgctgataaaagaaatcaaagaagacttaaatagcgtgaaatataccatgcttataggttggaaaacttaatatagtaaagatgccaattttatccaaattattacacaggataacattattactaccaaaatcccagaaaaattttacatagatatagacaagatcatacaaaaatgtatacggaaatatgcaaaggaactagagtagctaaaacaaatttgaaaaagaaaaataaagtgggaagaatcagtctatccagtttcaagacttacatagctacagtaatcaagactgtgatattgacagagggacagctatagatcaatgcaaccaaatagagaactaagaaagaagcacacacaaatatgcccaaatgatttctgacaaaggtgttaaaacacttcaacgggggaagatatgtctctcattaaagggtgtagagtcattgcacatctataggcaaaaagatgaacctgaacctcacaccctacagaaaaattaactcaaaatgactcaaggactaaacataagatatacatctataaaacatttagaaaaaggccacgcacggtggctcacgctcgtaatcccagcactttgggaggccaaggcaggtggatcacctaaggtcaggagtttgagaccagccggatcaacatggagaagccccatctctactaaaaatacaaaattagctggacgtggtggcacatgcctgtaatcccagctacttgggaggctgaggcatgagaatcgcttgaacccggggggcagaggttgcggtgagccaagatcacaccattgcactccagcctgggcaacaagagcaaaactccaactcaaaaaaaaaaaaaaaaaggaaaaatagaaaatctttgggatgtaaggcgaggtaaagaattcttacacttgatgccaaactaagatctataaggccagtcgtggtggctcatgcctgtaattccagcactttggtcaactagatgaaaggtatatgggaattcactgtattattctttcaacttttctgtaggtttgacatttttttagtaaaaaattgggggaaagacctgacgcagtggctcacacctgtaatcccagcactttgggaggccggggcaggtggatcacacggtcaggagttcgagaccagcctggccaacatggtgaaaccccgtctctaccaaaaatataaaaaattagccgggtgtcatggtgcatgcctgtaatcccagctactgaggaggctgaggcaggagaatcacttgaacctgggaggtggaagttgcagtgagccgagattgtgccactgcactccagccttgggtgacagagcgagactccgtctcaaaagaaaaaaaaaaaaaagaatatcaaacgcttactttagaaactatttaaaggagccagaatttaattgtattagtatttagagcaatttttatgctccatggcattgttaaatagagcaaccagctaacaattagtggagttcaacagctgttaaatttgctaactgtttaggaagagagccctatcaatatcactgtcatttgaggctgacaataagcacacccaaagctgtacctccttgaggagcaacataaggggtttaaccctgttagggtgttaatggtttggatatggtttgtttggccccaccgagtctcatgttgaaatttgttccccagtactggaggtggggccttattggaaggtgtctgagtcatgggggtggcatatccctcctgaatggtttggtgccattcttgcaggaatgagtgagttcttactcttagttcccacaacaactggttattaaaaacagcctggcactttcccccatctctcgcttcctctctcaccatgtgatctcactggttccccttccctttatgcaatgagtggaagcagcctgaagccctcgccagaagcagatagtgatgccatgcttcttgtacagcctacaaaaccatgagcccaataaaccttttttctttataaattatccagcctcaggtattcctttatagcaagacaaatgaaccaagacagggggaaatcaacttcattaaaataatctatgcagtcactaaacaaataagaacaagaggctccagaagtgggaagccaatacccagagttcctacaatacagtatctgaaaagtccagtttccaaccaaaaaatatatatatacaggccggacatggtagcttatgtctgtaatcccagcactttgggatgctgaggcgggcagatcaccctaggtcaggagttcgagaccagcctggccaatatggcaaaaccccgtctctactaaaaatacaaaaattagccaggcatggtggtggatgcctgtaatcccagctactcgggaggctgaggcagggaatcacttgaacccaggaggcagaggttgcagtgagccgagatcacgccactgaactccagcctgggcaacaaagtgagactccacctcaaaaaaaaaaaaaatatacatatatatatgtgtgtgtgtgtgtgtgcgcgcgtgtgtgtatatacacatacacatatatacatatatacagacacacatatatatatgaagcatgaaaagaaacaaggaagtatgaaccatactttctgtggttatgataggatggggtatcacgggggaagtagacaagggaaactgcaagtgagagcaaacagttatcagatttaacagaaaaagactttggagtaaccattataaatatgtccacagaattaaagaaaagcgtgattaaaaaaggaaaggaaagtatcataacaatattactccaaatagagaatatcaataaaggcatagaaattataaaatataatacaatggaaattccggagttgaaaggtagaataactaaaatttaaaattcactagagaaggttcaacactatatttgaactggcagaagaaaaatttagtgagacaaatatacttcaatagacattattcaaatgaaaaataaaaagaaaaaagaatgaagaaaaataaacagaatctcagcaaaatgtggcacaccattaatcacattaacatatgcatactgagagtaccggaagcagatgagaaagaggaagaaaaaatattcaaatgatggccagtaacttcctagatttttgttttaaagcaataacctatacaatcaagaaactcaatgaattccaagtaggataaatacaaaaagaaccacaaacagatacaccatggtaaaaatgctgtaagtcaaaaacagagaaaatattgaaagcagctagaggaaaacttataagagaacctcacttacaaaagaacatcacttataaaagaaccacaataatagaaacagttgacctctcatcagaaacaatgaatgataacatatttgaagtgctcaaagaaaaaaaataaagattcctatatacgacaaagctgtctttcaaaaatatacatccaaaaggattgaaaccagggtcttgaagagttatttgtacatccatgttcatagcagcattattcacaatagccaaaaggtagaagcaacccaagggtccatcgacaaataaataaaatgtggtatatgtatacacaatggaatttattcagtattaaaaaggaatgaaattctgacacatgctacaacatggctaaaccttgagaacactatgctaagtgaaataagccagccacaaaaggacaaataccatattacttcacttgtatgaaatacctagggtagtcaaattcagagatagaaagtaaaacagtggttgccaagggctgagggagggagtaacgtggagttattgttgaatgggtacagaatttcagttttgcaagataaaaagagttctggagacagatggtggtgagggtggtacaacaatacaaatatactttatactactgaacagtatacttaaaaatgattaacatggtgaaaccccgtctctactaaaaatacaaaaaaattagctgggtgtggtggcgggcacctgtaatcccagctacttgggaggctgaggcagcagaattgcttgaaaccagaaggcggaggttgcagtgagctgagattgcgccaccgcactctagcctgggcaataagagcaaaactccgtctcaaaaaataaaaaataaaaaaaatttaaaaatgattaagcaggaggccaggcacggtggctcacacctataatgccagcactttgggaggccgaggcaggcgatcacttgagaccaggagtttgagaccagcctggccaacatggcaaaaccctgtctctgctaaaaatacaaaaattagccaggcatggtggcatatacttataatcccagctactggtgagactgagacacgagaattgcttgaacccaggaggcagagattgcagtgagtcgagatcgcgccactgaattccagcctgggcgacagagcaagattctgtctcgaaaaaacaaaaacaaaaacaaaaagcaaaaccaaaaaataattaagcaggaaacgagattgctgctgaggaggagaaagatgtgcaggaccaaggctcatgagagcacaaaacttttcaaaaaatgtttaatgattaaaatggtaaattttatatgtatcttaccacaaaaaaaagggctggggggcaggaaatgaaggtgaaataaagacatcccagagaaacaaaagtagagaatttgttgccttagaagaaacaccacaggaagttcttcaggctgaaaacaagtgaccccagagggtaatctgaattctcacagaaaattgaagcatagcagtaaaggttattctgtaactatgacactaacaatgcatattttttcctttcttctctgaaatgatttaaaaagcaattgcataaaatattatatataaagcctattgttgaacctataacatatatagaaatatacttgtaatatatttgcaaataactgcacaaaagagagttggaacaaagctgttactaggctaaagaaattactacagatagtaaagtaatataacagggaacttaaaaataaaattttaaaaaatttaaaaataataattacaacaataatatggttgggtttgtaatattaatagacataatacaaaaataccacaaaaagggaagaagacaatagaactacataggaataacattttggtatctaactagaattaaattataaatatgaagtatattctggtaagttaagacacacatgttaaaccctagatactaaaaagtaactcacataaatacagtaaaaaaataaataaaataattaaaatgtttgtattagtttcctcagggtacagtaacaaactaccacaaattgagtggcttaacacaacttaaatgtattttctcccagttctggaggctaaacacctgcaatcaaggtgagtacagggccatgctccctgtgaaggctctaggaaagaatcctcccttgtctcttccagcttccagtggttctcagtaaccctaagtgctccttggcttgtagctatatcattcctagcaaccagaaagaagaaaataataaagattatggcaaaaaataatgaaatcaaaaggagaaaaatggaaaaaaataaataaaaccaaaagctagttctttgaaaagatcaaccaagttaacaaaccttttaactagactgacaaaaaggaggtaagactcaaattactagaatcagaaataaaagaggggacattactaatgagggattagaaaagaatactacgaacaaatgtgtgccaacaaattagaaaacttagatgaaatggacaggttcctaggacaacatcaactaccaaaatttactcaagaagaaagagacaatttgaatgagctataacaagggaagagactgaattgacaaccaagaaactatccacaaagaaaatcccaggcccagaagatttcactgtgaaattctttcaaacttataaatataaattaacatcagttcttcacaaactcctccaaaaaaaagaacagatctctatttacaggcgatacgatctttagaaaatcctaagggaactactaagacactatgataactgataaacaagttcagcaaggctgcaggatagaaaaccaatatacaaaaatctattatatttctatacacttgcagtgaacaacccaaaaatgagattaagaaaataattcaatttacaataacatcaaaaagaataaaaacactcaaaaataaatttattcaagtaagtgcaaaacttatactctagaagctacaaaacactgttaaaagaaattaaaggtttacataaatgaaaaactatcccatgttcatggatcaaaagacttattactggcaatgctctccaaattgatctataaattcaacaaaatccttatcaaaatcccagatgaggctgggggtggcggttcatgcctgtaatcccagcactttgggaggctgaggcacgcagattacctgaggtcgggagctcgagatcagcctgaccaacatggagaaaccctatctcttctaaaaatacaaaattagtcaggcgtggtggcacatgcctataatcccagctactcgggaagctgaggcaggagaatcgcttgaacccaggaggcagaggttgcagtgagccaagatcgtgccattgcactccagcctgggcaacaagagcaaaattccatctcaaaaaaaaaaaaaaaaaaatcccagatgacttcactgttgaaattgaaaagattattctaaaattcacatggaattgcaagaccttgagaatagccaaaacaaacttgaaaaacacgaacaaaatataggatgactcacttgccaattgcaaatgttacgacacagcaacagtaatcaagactgtgtggtactggcaaaagacacatacatacatacatatcaatggaatataattgagagtacagaaacaagcctaaacatctatggtaagtgcttttctatttttttctttttttttttcttttttgtagagatagaatctcaccatgttgcccaggctggtcttcaacttctgggctcaagcaatcctcccactgtggcctcccaaagtgctgggataactggcatgagccaccacatccagcccagatgattttcaaaaaagtcaacaagaccattcttttcaacaaataggtctgggatgatcagatagtcacatgaaaaaaaaaatgaagttggaccctccatcacactaaagtgctgcgattataggcatcagccaccacatccagcccaaatgattttcaaaaaggtcaacaagaccattcttttcaacaaataggtctgggataatcagatagtcacatgaaaaaaaaaatgaagttggaccctccatcacaccatatgcaaaaattaattcaaaaatgaattgatgacttaaacgtaagagttacgactgtaaaactcttagaaggaaacatacgggtaaatcttaaagacgttaggtttgacaaagaattcttagacatgacaccaaaagcatgaccaactaaggtaaaatagggtaaattgtacctaccaaaatgaaaaacctttgtgctggaaaggacaccatcaagaaatggaaagccaaaatagccaaggcaatattaagcaaaaagaacaaagctggaggcatcatactacctgacttcaaagcaacagtaaccaaaacagcatggtactagtagaaaaacagacacatagaccaatggaacagaataaagaacccaaaaataaatccacatatttatagtcaactgatttttgacaatgacaccccttcaataaatgatactaggaaaactggatatcgatatgcagaagaataaaactagacccctatctctcaccatatagaaaaatcaactcagactgaattaaagacttgaatgtaagacccaaaactataaaactactggtagaaaacataaggaaaaacgcttcaggacattggtccaggcaaagatcttatggctaaaacctcaaaaacacaggcaacaaaaacaaaaatggaaaaatagcactttattaaactaaaaagctcctgcacagcaaaggaaacaacagaatgaaaagacaacctgtagaatgggagaaaatatttgcaaactatccatccatcaagggactagtatccagaacacacaagtgactaaaacaactcaacagcaaaaaagcaaataatctggtttttatatgggcaaaagatctgaataaacattctcaaaggaagacatacaaatgtcactatcattctgccagtaccacactgtcttgattacttgttagtgtataaatttttaaattgggaagtgtgagtcatcctacactttgttcttgtttttcaagtttgttttggctattctgggagccttgcaagtataaaatagccaacaagtatgaaaaaatgctcaccatcactaatcatcagagaaataaaaatcaagaccactatgagatatcctctcactccagttagaatggctactatcaaaaagacaaaatataatggatgctggcaaagatttggagaaaggggaactcctatacactgtgggtagggatgcaaattggtaatggccattatggaaaataatactgaggtttttcaaaaaactgaaaatagaactaccatatgatccagcaaccctactactgggtatttatccaaaggaaagaagtcagtatactgaagaaatatatgcactctcatgttaattgcaacactgttcacaacagccaagacagggaataaatctaaatgtgcatcaacagatgaatggataaagaaaatgtggcatatacactcaatagaatactattcagccattaaagaagaatgaaatcctgtcatcccagcaacatggatgaacctggaggacattatatttaatgaaataagtaaagcacaaaaagataaacagtacatgttctcactcagacatgggtgctaaaaagaaaatggggtcacagaattagaaggggaggcttgggaaaagttaatggataaaaatttacagctatgtaagaagaataagttttagtgttctatagaactgtagggcgagtatagttaccaataacttattgtacatgttcaaaaagctagaagagattttggatgttcccagcacaaaggaatgataaatgtttgtgatgatggatatcctaattaccctgattcaatcattacacattgcatacatgtatcaaattatcactctgtacctcataaatatgtataattattacgtcaacaaaaaaaggaaaaaaaagaaaattaagacaacccacataatggaagaaataaaatatctgcaaattatatatatctgataaatatttaatatttataatatataaagaactcctacaactcaagaacaacaacaaaacaacccaattcaaaaatgggtaaaagccttgaatatacacttatctaaagactatatacaattggccaataaagacacgaaaagatgctcaacatcactagtcatcagggaaatataaatcaaaaccacaatgtagaatgtagacaccacttcatatgcactaggatggctagaataaaaaggtaataacaaatgttggtaaggatgtgaaaaaatcagaaacctcattcgctgctgttgggaatgtaaagtgatgcagccactttggaaaacagtctggcagctcctcaaattattaaatacagagttaccgtatgacccaggaatattcctcctgggtctataaccaaaaaaatgaaaacatatatccacataaaaacttgtacatgggcatttatagcaacattattcataacagcaaaggtggtaagaacccatatgcccatcatctgatgaacaggtaaataacatgcggtattatccatacactagaatattatctgcccatacaaggagtgacatccagctacatgctacaaggatgaatctcggaaaccttatgctaagtgaaagaagccagtcacaaatgaccacagattatgattccatgcatcggaaatgaccagaatagggaaatctatagagacagaaagtagattagtggttgggtggggctgggaggacaggtagtacactactttcccagaactactggaacaaagtaccacaaactggggagcttaaacatagaaattgatttcctcacagttctggagactaggactctgagatcaaggtgtcagcagagctggttctttctgagggccctgaggcaaggctctgtcccaggcctctctccttggctggcaggtggccatcttctccctgcgtcttcacatcatcttttctctgtgtgtgcccatgtccaaattttgattggctcattctgggtcatggccaattgctatgcacaaagtgaagtctacttccaaaagaagggaagagggaacactgactaggctaaacttatagtcattttaatgtccgcttttcctatgagattgtgaacacacagaagtagggtttttatctacattgtgcaaagtttaataagaaaaatagaattcaagagaagcagttcaatagcaggaatttaatatgggaactaattacaaggtttagggcaggactaaaaagccagttgggatggtgagccaacccagagattagcaacagtgggaccccatctacctaccacccatgaagctggaaggataaaggaggggctattatcagagtccacaagccagtgtcagagtccttggctggagctgggaccaccctagagacactgtgcaaagcagaaaacaagggggaaaaaccctgacttctcccttcctcccacctttcaatctcccactagtgcttcctactagccatacttggccagagacagtgacaaggaacactgcaaaatgaagtttgtaggaatcatctccctctgagacagagaaatatggaagggtagaaaatgaatcagaggataaagagaaaaaaccctgagtactatcttatttatctttgtatctccagtgcctaatctgtctctcaaaaaaggaaagcaattgagagaaactgaaaactccaattgaaatgaaagaatggagaattactggactagaagagaagagaaaaatttattccgcatagagtaaacaagaatggattcacaaaggacgtgatgaatgaaaagctataatcagcaaagatttgccagagaaattaaaaagtggtaaactcagccacgctgtacaacctgaaggcacaatgcatgaaaacgtttcaagaaatgacaagatttgaagtcaaattctaagtgcttttccagaatctctcaagacgattatatagctaccccattttattaaataaaatggaaacttactaaactttccccttgtattaaactaacatatgtcctaatagcaaacgattctggaattcctagagtaaaatatatttcgtcaaagtgtattgctcttttaatattctgctgacctccttttgctatttaggatatttgtatacacatcacacgtaaatttggtctatagtttacatctacgggcttatactgttctttttttcatttttttaaaatttccaacccccagtatccatatactgctctctatcagggttattttaactttgtaaaatcagctgagatgctttccatgttttttttttttattttctgccacatttgaatagcataggagttaccaccatcaaccttggattatttaagcattcacgattccacgtgtggattttttattcagagtctttcttgtcattcctgctatcagcacagaacccaatctcagctttccagctatactctcaccccatggaatttgcagatgaagttcaaaaggacctttgcattatcctgcctcgccctcttcccccttcatttagacatcaccttcttctagaacgtcttacctgacatgccctgctcccaacccctgctgcccaattgtgtgctctcccgtgtcctggcctgccatcctctttagtaattgcctgctccctcatctgtctccccacccagacattaagctgaatagactggatttgtgtcttgtccatcactataatctcagcacctagtacctagtaggtacttaccatgtattcattagcaaaatgttatgtataaccttgcaccttaaaaacaagagaaggaagacaaaattaagtcttaagactatggtttagaacatggatcagaaactacagtctgcagcccaaatccagaccaaatgaagagaccatgttcatttacatacaacctatagcagctttcacactacaggagcagagctaagtagttccaagggaacacacggccctgcaaagcctaaaatatttactctatagctcttcacagaaaaagttttcagatccctcgtttagaactcttgttcatatgcaatttcactaaaccatagttttttgggtttgtttggttttttttggcaaaaaggaatgagccgatccagaaaaggttgaaaagaatgaatcattactgctgaaagaatgtgcacacagtccgtcagtattctgctgccatgctgacacccatccaatagtgtcatgagatgcagcagctactactgtgttctcaatgccgagtccacccactccataaccatgtccaagcaatcttgggaacatcatcaccatgcttgtttatccttaaggtattgcctcacatacagcagtggctggtcataaagtcaaatgacactagtggccaggaggtcaagagaatgagtgaggacaggtgggtaggcagcccaggccctagcaacagcaggagctcacccctcagtcactctagccaggactgaaatacttttcaccctttcaagagagactaggaatctggatttttatgtgaaatatcttgattactaaatgttgtcaacagacatgtcaaaaggtaaaactaagtaagttcatggggcagattgactattcaggttatagaattaaggattcttatccaacacagataccaaccaaaaagctgacgtataacatattaggagaaactatgtgcactgtcgaaacatcaacaaggggctaatgtctaaaatagtctatattggattccagttgaaacatggggaaaggacatgaacaggcaacttatgtcaatggaaactcaaaaagataacaagcatatataaaagcattctcaaattcagtagtaaacagacagatgcaaataaaaagagggaaactgctgccgggcacagtggctcacacctgtaatcccagcactttgggaggccgaggcgggcggatcatgaagtcaggagatcgagaccatcctggctaacatggtgaaaccccgtctctactgaaaacacaaaaaattagccaggcgtagtggtgggcaccagtagtcccagctactcaggaggttgaggcaggagaatggcatgaacccaggaggcggagattgcagtgagccgagaccatgccactgcactccagcctgggcgactgagtgaaactccatctcaaaaaatataataataattataattataataataataaatagtaaataaataaaaagagagagactgctaaagtctagaaagttgaatgatgccaagcgcatgcaaagatcagggccttgggatggccgggtgcagtggctcacgcctgtaatcccaccactttgggaggccaaggcgggcggatcatgaggtcaagagatcaagaccatcctggccgacacagtgaaacccggtctctactaaaagtacaaaaaaatatatatatatatatatattattatattatatatatatatatcagagccttgggaatccttgtgtgctgctggggaaggtagtggtgcagccacccttgacagcaatctggcagtacttggttatattaagtataggcacacaccacgaccaggcagtcctactcctgggtctaaatcccaaagaattctcacacaagtccataaggagacatgtacgaggctcattcagcattactgggagtgggaatcaacctgggtgtccatctacaggagacgagatggacaaaatgtggtggatattaagaccagaatcaccaagtaacagagatgggtggtgagtgacaatcctaagatacagaataaaggctagaacatgatgccattcatgtaaattaaaaatagatgcacacaaagcagtatacgcgtgacccttgaatagcacaggtttgaactgcctgtgtccacttacatgtggattttcttccacttctgctacccccaagacagcaagaccaacccctcttcttcctcctccccctcagcctactcaacatgaagatgacaaggatgaagacttttatgataatccaattccaaggaactaatgaaaagtatattttctcttccttatgattttctttatctctagcttacattattctaagaatatggtacataatacacatcacacgcaaaataaatgttaattgactgtttatattatgggtaaggcttccactcaacagtaggctgtcagtagttaagttttgggagtcaaaagttatacacagattttcaactgtgcaggcaatcagttcccctgaccccctcattgttcacgggtcaactgtatatacacaaaagtattatatgaacctcattagaatagctgtctatagggagaagagaatgagagtgggataaaacggaatgaacaaataaaccaacaaatgcattaacaagcaaaacaacagaggggcttgcatgggccagtgatgataaagggctaagaatgagaatataattaattcaattcctcacacctgaggtctaaaaccaaggaaagggagggccaggcgtggaggctcacgcctgtaatcccagcactttgggaggctgaggcgggcggatcacaagattaggagtttgagatcagcctggccaacacagtgaaagcccatctctacaaaaaatacaagaattacccaggtgtggtggcacatgcctgtagttagctactctggaggctgaggcaggagaatcacttgaacccaggaggcggaggttgcagggagccgagatcacaccattgcactccagcctgggtgacagagtaagactctgtctcaaaaaaataaaaaaaataaaaaaacagagaaagggaggaaactagatccaggctgactagatacagcctttagagttagaaaagatgatttgacaatctaagcccacactcagattgaatgaaattgaaaagcctttcaaactaaaacatttaattacaccatctgctgcagacagaactcagacaactcaaacaggtaatgtcagcgtggtgttttatatcaccaccctcaacacagaataaaaatcagctgcatgtgaagcagtgactagaatgaagaaaaggctgcttcttacttccttctagtggttctttccgaaaacattaataggcaccagctctatgcatgtcaccctgcagggagacatggggtatataactatgacttactgttcattcctcaaggaattcccaatcttgtggaagattatacacaatgaggcaacaaaaactatccaataaaaccacggaaaagaagccagtgacaaagaagccagtgatgaaaggccctgtgagcagagctgatggccatttggggaagaaagaccaacatggatgggggtgatcagggtggctccgtgggaaagctggaagagaagtggcagatctctgagctggatgatgggccactaccatctgtatatggctaattaaagaccatgtgtggattttttattcagctctttcgtgtcattcctgctatcagcacagaacccaatctcaactttccagctatattgagctaaacttctcacctcatggaatttgcagataaagttcaaaaggatccttgccttttcaaaataattttgaatggttgagtagtccctctgtgctctctcactgacaccctctcaaggctgctgagcacgtgccatgctatggctttctccaacatcaggaaatgttctccactcagtttcaccttaatacaaatgtgttctctcttcagagaaggcaaaaaaattcatgaccatctgactgggagaagtcatttctaggtaaagtgtccatctttttctgaggaacacaggaggaaaatcttacagaaaagagttaacacagcaggcctaagactgctttttaaaataaataaataaataaataaataaataaataaataaataaataaataaataaatgaatgatagggtcttctgtattggccaggctagtctcaaattcctggcttcaagagatcctcccaccttggtctcccacagtgttgggattatagacatgagccattgtgcttggcccaagactgttattcttaaaaagtctcataaaaagcatggttaatccttggctggcacctgggaacttagatttcagaagggttcccaccatccaacctggaaagagggactcactgtgcctaaattattgtgtggtttatgctgaactcctgcttttcttcaggtagcgtggaatgtggtatgtgctgggcaaagggggcctgcatgaccagcccccaataaaaaccctgggtgttgggtctctagtgagtttccctggtagacagcatttcacatgcgttgtcacagctccttcctcggggagttaagcacatacatcctgtgtgactgcactgggagaggatgcttggaagcttgtgcctggcttcctttggacttggccccatgcacctttccctttgctgattgtgctttgtatcctttcactgtaataaattacagccgtgagtacaccacatgctgagtcttccaagtgaaccaccagatctgagcatggtcctgggggcccccaacacagaaataaattataaaagaccaaggactgggcatggtggcccatgccggtaatctcagcgctttgggaggccgaggcaggaggaccagttaagcccaaaagttcaaagttacagtgacctatgactgcgccaatgcactctaacctgggagacagagcaagaccctgtccccaaaacaataaactaaacacatacttctgccttccaagtgtcttaaaattcaatggaatggtagaaacatttttaaaacactaaatcaaaagaaacctggaaaacaagagtgccgatggccaactaaaatgtctaggaaatttctgaaaagtaaaaagtactcagaaccagattacctgagcaaaccatagcccaatacaagcttgggaggaggctgttatgcagaaggaaatggtaacaggtttccaggaacagacttgtaacagcagatagaacagcagaggtagaacctgacaaggtgattacctggggaactgcagtctgaatgaccaggactgttggacccttcccctcacatggaatacacacgccactcagcagcacaccacagctcttcaacaatcacaggaggcacgctacgcctagtaagacaggaaaaaaggaattctcaaacttcgaagatgaacacataaagaatcaccaagtttttattcagtatgatgaaacagggacactgaatcaacagaacacaaacccaagcaaagataattactagagcacatagaagaaattattagatattcttgggaagacctaaggggacattataaagagcaagcagttggtatgtgacgatctttgtgatataccaagaaataaaaacacaggatgaagaccagatagagaataatgctactatttgtgcaaaaaaggagaaatggagaatctgattcatatttgcttgtatttgcatgaagaaactttggaaggtacataagtaactaacaacaatggttacctacttgtaaggcgagagaagtaagaggacaggaatggtgggaacaccttttgtgtccggaattggtgggttcttggtctgacttggagaatgaagccgtggaccctcgcggtgagcgtaacagttcttaaaggcggtgtgtctggagtttgttccttctgatgtttggatgtgttcggagtttcttccttctggtgggttcgtagtctcgctgactcaggagtgaagctgcagaccttcgcggcgagtgttacagctcttaagggggcgcatctagagttgttcgttcctcctggtgagttcgtggtctcgctagcttcaggagtgaagctgcagaccttcgaggtgtgtgttgcagctcatatagacagtgcagacccaaagagtgagcagtaataagaacgcattccaaacatcaaaaggacaaaccttcagcagcgcggaatgcgaccgcagcacgttaccactcttggctcgggcagcctgcttttattctcttatctggccacacccatatcctgctgattggtccattttacagagagccgactgctccattttacagagaaccgattggtccatttttcagagagctgattggtccattttgacagagtgctgattggtgcgtttacaatccctgagctagacacagggtgctgactggtgtatttacaatcccttagctagacataaaggttctcaagtccccaccagactcaggagcccagctggcttcacccagtggatccggcatcagtgccacaggtggagctgcctgccagtcccgcgccctgcgcccgcactcctcagccctctggtggtcgatgggactgggcgccgtggagcagggggtggtgctgtcagggaggctcgggccgcacaggagcccaggaggtgggggtggctcaggcatggcgggccgcaggtcatgagcgctgccccgcagggaggcagctaaggcccagcgagaaatcgggcacagcagctgctggcccaggtgctaagcccctcactgcctggggccgttggggccggctggccggccgctcccagtgcggggcccgccaagcccacgcccaccgggaactcacgctggcccgcaagcaccgcgtacagccccggttcccgcccgcgcctctccctccacacctccctgcaaagctgagggagctggctccagccttggccagcccagaaaggggctcccacagtgcagcggtgggctgaagggctcctcaagcgcggccagagtgggcactaaggctgaggaggcaccgagagcgagcgaggactgccagcacgctgtcacctctcactttcatttatgcctttttaatacagtctggttttgaacactgattatcttacctattttttttttttttttttgagatggagtcgctctctgtcgcccagactggagtgcagtggtgccatcctggctcactgcaagctccgcctcccgggttcacaccattctcctgcctcaacctcctgagtagctgggactacaggcaatcgccaccacgcccagctaattttttattttattttttttttagtagaagcggagtttcaccatgttagccagatggtctcaatctcctgacctcgtgatccatccgcctcggcctcccaaagtgctgggattacagacgtgagccactgcgccctgcctatcttacctatttcaaaagttaaactttaagaagtagaaacccgtggccaggcgtggtggctcacgcctgtaaccccagcactttgggaggccgaggcgggcggatcacgaggtcaggagatcgagatcatcctggttaacacagtgaaaccccgtcgctactaaaaatacaaaaaattagccgggcgtggtggtgggcaccggcagtcctcgctactggggaggctgaggcaggagaatggcgtgaacctgggaggcagagcttgcagtgagccgagatagtgccattgccttccagcctgggcgacagagcgagactccacctcaaaaaaaaaaaaaaaaaatagagacccggaaagttaaaaatatgataatcaatatttaaaaacactcaagagatgggctaaagagttgacggaacaaatctaaatattagattggtgacctgcaaaaccagcccaaggaacatcccagaatgcagcccataaagataaagagagcatttccgctgggcacagtggtatggcaggggaattgcctgagtccaagagttgcaggtcacattgaaccacaccattgcactccaggcctgggcaacacagcaatactctgtctcaaaaaaaaaaaaaattaaattaaaaaagacagaatatttgagagaaaaaaatgcttatttcaagaaacatgaaagataaatcaagatattctaattcccaagtaagaataattccagaagcagaaaatagaatagaggcaaggaaacactcaaaacttctccagtgccatagaaatgtgtattaatctttagaatgaaacggactaccaaatgctgagcaggaagaacaaaagagatccactcttaagccagtgtggtgcccaagcgcagtggctcatgcctgtaatcccagcactttgggaggccgaggcaggtggatcacctgaggtcaggagtttgagatcagtcaggccaacatggtgaaaccctgtctgtactaaaaatacaaacattagctgggtatggtggtgcacatctgtaatcccaactacttgggaggctaaggcaggagaatcacttgaaaccaggaggtggaggttgtagtgagccgagatcatgccacactcccagcctgggtgacagagcaagattccatctcaaaaaaaaaatccactcctagacaaataatagttaaattttagaacaccaaggagaaagaaaaaaaattgtaaagcttcagagaaaataaacattaactacaaagaaacgagagtcagacgcgtgcacttcttcctagataccagcagataaagcaatatctccaaaattcagaaggttttaacgtagaatcctatacccagtcaagaatattcacatggaaaagtgaaataaaaaacattgtttaaacatgcaagggttcagaaagtttaccattcacagaatccctgaaaacaaaaccaaataatcacttaaggactcattaagaaaacaaatgaaataaaagcaccaatgatgagtaaataatcagaaaaatttacagtttacctaaataactgtttatgcataatgtatgaaaacccaaaaatttaatatgggacagaattaaaatcatgataagattcttttttgctttactcatggagagttcacataaacagattatcttttaatagcaagagaaaaaaatgtttagatatgtgtgaaaaactaagggtaccaaaacagtgcaaattcatttatcatcaggaaaatccaaattaaaaccacagtatccaccagaataactaaaaggtaaaagacagaaattaccaagagttggcaagaatgtggagcaaccacatatacttctggggtaaataagttggtgcaaccggtactgaaaactgtttgctagtatctactaaaaccgagcacatgcacagactacaaccaagcagttccactcccagatacacactcaacagaaatgcacacactcactcaacaaaagacgtgtactagagtgttcatgtacttactattcataatagtccaaaaatgcaaacaaccaactgccaatcaaagtcaaatgtatatctatattagggatatatacaatggcatatacacagcaatgagaatgaaatgaaccagctcggcacagtggttcatgcctgtaatctcagcactttgggcgggtaaggcaggcagatcacttgaggtcagaaatttgagactagcctggccaacacggttaaaacctgtccccactaaaaacacaaaaattagccgggcatagtggttgcaggcctgtaattccagctactcgggaggctgggttgggagaatcgtttgaacccgaaagccggaggtcgcagtgagcggagatcgtgccactgcactccagcctggacgatagagcaagactccgtctcaaaaaaggaaatcaaaaatataaaataagatgacaggaataatccgcaaaagatcagtaatcaaaataaatataaatgggctaaagctacctattaaaagacaaagatttcacacccataaggatagctactatcaaaaaaagagagagaataacagatgttagcaaggatgtatggaaactgaaattctcacgcattgctggtgagaatataaaatggttcagcctctgcggaaaacactatgctgggtcatcaaaaaattaaaaatagaagtactacttgatccaacaattctacttctgggtatatacccaaataactgaaagcagggtcttgaagagatatttgtacacccatgatcatggcagcattattcataatagctatgatgtggaaccaacataaatatcctttgataaatatatggataagcaaaatgtggtgtatacattcaatggaatattaattagcaataaaaatgaagaaaattctgacacatgctacaacatggatgaaccttgagggcattacattaaatgaaataagccagttataaaaagacaaatactatatgaggtactatattagatactcatgcaaggtacctaaaataggcaaattcatagagacaaaaagcagaatggtggttgccaggggctgcggtaatggatacagagcttcaattttgtaagatgaaaaaattctggagattggttgcataacaatgtgcacacacttaacactggggaactgtaaacttaaaagtagtaaatggtaaaaataaaaataataaataataaattttatgttattttaccacaatatttattaaaagacaaagattaactaattaaacaaaatccagccataagctaatggtaagagtaacaattaaagaagacacagaaaattgaaaatcagtgactagaaaaagatattccatataaatgctaacaaaaagcaagtacagcaatataaagagaatgaacaaaaaaaaaattaaataagatggctcgtttattcccaaaaggtacaattcaccaagaagatacaagaattgtgaacctttaagcacataaaacagcttcaaaaatacaacatttaaagaaaaatatatattaaacatagaaatagtacaaaaacccctacaagaatcataatgggagtcttcaatacaactctccatatcaacaggtcaaacagagaaaaaaaataagttaaggatgcagaaaacctgaattaccatcaataaacttgagattaatatagaactgtatacccaatatactaagagttcagggaacagtcgtgactgacagtggactgcaaattaatctgttcttaatctttgtttttctttcagcactgtggcagaatagagatcctaaaaaccttccagctacaaaacatctttttaaaaatataaaaaaatacaaaaataactctgaaatcaatagaagacacatggtgaaaccaaaattctagaatacagggagaataaaggcattttcagatattacaaaaacagaaaattgatcattgctgaagtaatttctaaagaatgtacttgagggagaagaaaaatgttccaaagaaaagtatctgtgatacaagaaggaatggaaagtgaagaaatggtaaacaggtagataaagctaataaatgttgacctagaaaataacaaaaacaatagcaataatgtctcgttggaagggttgaagtaaaaatacaattaaggccaaatgtgaggtaagtggaatgaaagaattagaagtccttgccttgttcacaggactgattaaataaatgagccaggttttccattcaaacagttaaaacttgaacaaaataaactcaaattaagtagaaagataaaaaacagaaattaatgtcatagaaaaataaaaaatcaatagaattaatcaataaatcctggttaataaaagctggttctttgaaaggattaataaaataatcattaagcaagtctgatcaaaaaaaaagagaaaaggtaccaaaaaaagtactgtatcagaaagagaacatacagatacatacagatatgtaagagtctgttttcttacaccagaatactatatacaacattatgctagcatatattaaatttcaataatgttaatgattttctaggaaaacagaaaatattaaatttactttgaagaaacagaaaaactgagaaaaataaatgatcatgaaaaaaatgaaaaggtaattaaatactgatattaactgcctaaacaacaccagcagcagcccaggcagtctgcagtcaagttctgccaaacttgagggaacagataattcttctattccagagcatagaaaatgatggaaagtttcccaatttaatcagagaggacagcctgatccttgttatgaacacagataaaaatggggtaaactatatgccaaactcagataccaaaaccctaaataagatgctagcttattgatgtgaacaatccaaaagtgcattttaaattagcccagggttttagagaaagaaaatctagcaatgtgaccaccacttatgttaacaattttaagacgaaaatctacatgatcatatcaatgcatgctacacaaaagcatttgggcaaaaaacccaacacccacccttgactttttaaactcttagtaattaggcataaacagaaatgtacttaatgtgatagaatacactcggtgaagatacagagggaatgctccctaaaaccaagcccaagacaaagattcctatttaacctcaatagtcaacactgcagcgagagtaatctatggaagacaaggaaaaaagtaaaaacatgagagacatctgttgtttaacagacaataagatcacctacttggaagaggcaaacgaatcaagcgaaaaactattaaaactgagacaggctttagtatggaggctcagcttcagctgtagtttgggctaccaaattcaactcgcttgcttggagagttaatcctgcaaagctaatttctgttgaggtattaggattgacaagcctgtgctcctccctcctcccccatcttcaacactgaaataacacggtgtttggaactggataacagaatcttccaaaaacaaaaattgtcctgaagggctgacttgtgcccttactcaaaaaacactttatctgctgcctgcagctcctacagttgctggtggataagcctgccaaccagctcggcgtaattcttcctgcagagggcaaggaagagcactttcacaggaaaatttttttccgaactgtatgccgcttattacataaacttacgtgctggcaaatggagctccagcaaaataagatattcagagtcaaacttccttaggaaaaaaaaaaaaaaaaagcaagcacataacactaatttccttgcatgggcactggggaaggaggtcgttacttccgcacgcccgcaggtccgcaccaccgggaaacccacgggcaccgcgcgctgcccccgggccttccaggtgcactgcgccgcggcgccccagctgacccgggatgcgcagccctagcccttcccctgtcaccccggccaggaaggggcgggagcgcggcggacgccgagggcgaagggcttctcggtcctctgcaccacgcagcacccccaaggcacaacagggagggtgcgggaggctcccgagacccaggagccggggccgggcgtgcccgcgcacctgtcccactgcggcgagggctggggtcgcctccagggccgcagctgtcgggagccacctggctctcagtcccgggtccctgcgacaaccctcgggcccggaggggaggaggcggccacctgccgctgccacctgcggcaccggtcccaccgctccgggccgggcaggacaggccaggacgtccctcctgggctggggacaggacacgcgacgaggggaccggggcccccgcggcgaagacgcagcacgccttcccagaaaggcagtcccgtgcccccacgacggactgccggacccccgcgctcgcccgcccatcccttcagaccacgcggctgaggcgcaaagagccggccggcgggcgggctggcggcgcggctagtactcaccggccccgctggctcagcgccgccgcaacccccagcggccacggctccgggcgctcactgatgctcaggagagggacccgcgctccgccggcgcctccagccatcgccgccagggggcgagcgcgagccgcgcggggctcgctgggagatgtagtacccggaccgccgcctgcgccgtcctccttcagccggcggccgggggccccctctctcccagctctcagtgtctcatctccctatctgctcatcctctggtcgcacataatcgatgtttgggcgtcccaagccagatgtggaccccatttccgcactctacactggaggttttctaagggtggtgcccggaccagcagcttcagcctcatctgggaacttgagaaaatgcagattctccgtcccacccagcctattcggtttttcctgcactaaaaccatgaaggtggggcccagcagtccacattctcgcaagcccgtcaagtgattctgaggcgccctccagtttgagagctatgctcacggcctcacctccgccccgcaaggagcccggtcttgcctgtggcgctagccgcacacggacacctcatcctgcggggcccgcccccccgctgcaccctcaccgcccaacgcctcctccgggatgcagcggaggcgcctggaagtcggcaaggtcaacatccccctcagcatcttccctaccctcacggctcctcctccaggggtgcctcatggccaggggttagaaagagccactgtgtttcttgacatggaagtggcctaagaccttaatgaaaactgcaggagtggaatgacagaacctttggtcatacttgagggcgtgaagctcaaatgaggaggaaggaaaggatccagggagaataaccaaccctggcaagttgtggcgcccaggtagaggggcgagcctaggctagcggttctcgaccagggccggtgttgcccctcctcgccgccccgcgtacatttggggaggtctggagacatttttggttgtcatgatgcgggagttgctactgttgcctaagtgggtagacacgagggtgctcctcaacatcctacctgaaggacaggactgccccacaaggaagaatgatccggccccaaataagaaaccctgggctggtcagcaacaacccctttgttctgagaagagaggaggaaagaataaaagaagtggggtgaagttttggtttggtagaggaaacttgaagacattttcactggaaaggaagagaggaagaggagggagatgtctgtaaggacgagcaaaccgggtgacagctgatttcctcatattgaagtaatgagtcctagttataataaattcctaataaaaacccagtttatccctgcaataaacttgtcttttttttttaaatatactgcttgattctgtttgctaatattttatttacaggctttgcattgatatgcaaaaatgagatgggcaataattttctttttgaatgtctaatgttgtttggtttcagaatcaatgttatgctcacatcataaaaaatttggaaccgaggcaggaggagtgcttgaggccagaagttcgagaccagtctaggaaacacagtgagacccccccatctctacaaaaaaaaaaaaagaaaaaaaaatgggcatgtttgctttttccttttactctgaacaatttaaggagcattaaaattatctattctttgaggtttgatcatttcccagttaaaaatgttcctcccagcctgatgctttctttggggagggtaaatcttttaaggctagaaaagtttcttctgtggcaattttattatttacattttaaaaattattctagagttaattttgataaagcatgtatttcttaaaacaaattatcctttttttccagatgttcaagtgtatttgcataaagttgaggaaagtagtcttttgtgaatcttttaacttctcccaaatatcttattttgtgtatttttgcttctttattttgttaacttttaaaagtgtatttttttttcaaagaatcagctcttaggtttatgtttttggttatactggagcttttttcttcttctttttaaaatattttttctcctttattttttagacgtattttgatctaacgtaatcggaagaaggtaaattagaatcttttgttactattgtgtttttatttctccttatttctctgaagtcctgctttataaatagtaccatgttatttgtgcataaatattcatttgtcttatattcttgggaattttcccacttcatcataaaatgaccttccttgtctcatttaatgtgttcaaactttgccctgaatttaactttgtctgatattttaccatcctgctgaattttgtttgttaccccaaacaacctttgctgttttcgtcttttctgaaccctttattttaggtaatcccttgaattagagcactaagttttgctttgtgattaaatctgaaaatctttatcttgccatagatgagttgagccctattcatgtgacagctatattatgctgtttcatagcccttttggtccttttttcactcttgcattgcatattttgtgtttattgtgttttgtgtttcttctgataatttggaaggtttgtatttttattcagggagttgccttataatcatactccgcaatacacatcgtcctcagtttcttcagactgtctgttaactccctattctgaataaaaatgacattgtaatttccctcttttttctttaccccttttcttctcctcacctaatgtaaatgattttatccttctttagtatttgcttttttaattaactacatttataaatatctttatcacttgatttttaaatcagctttgaatgagatatttggattcctagatataaaagatgttaattataccatttccacgttagtaggtttataaaatcatacattctgctgtgtaaccataatcccacgtttgttttagttccactcctacagttaaaagattcagaagtattattaacagttattttgccatagttttttccccaacccattttgtggtaagttatgatcctgctttagtttcttaagaataatttatagagcagagtgtggtggctcacgtttgtaatcccagcactttgggagacaagaggtagaaggatcgcttgaagccagcagttcaagaccaccctgagcaacatagtgagaccttgtctctacaaaaaattttaaaatttagccagacgtagtggcgtgtgcctatagtcccagctactcaggaggctgaggcaagaggattgctagagcccagaagtttgaggctgcagtgacctctgattgtgccactgcaccccagtctgggcaagaaagtgagaacctatctctttaaaataacaataataacttatgaaaattatattccctgagtttttcatgtttaaaaatatttgttgcctttatcctgtaaaagtttgagtataaattcttgggttatactttatttattgaagaatgtataagtattgtcttctagaattgagtgttgctgtaatgaaaccagaagtcagcctggtttatttttcctcagaaatgaggtaattgccggccggacaccgtggctcatgcctgtaatcccaacactttgggaggccgagacaggtggatcacgaggtcaggagattgagaccatcctggctaacatggtgaaaccccggctctactaaaagtacaaaaagttagctgggcatggtggtggacgcctgtaatcccagctacccgggaggctgaggcaggagaatggcgtgaacctgggaggaggagcttgcagagagctgagatcgcgccactgcactccagcctgggcgacagagtgagactccgtctcaaaaaaacaaaaaaaaaacaaagaagtgaagtaattgccatgatgctccaagaattatctctttgtctatgaaatccagaaatctcactgttatacattttggaattattattctgggccaatatttcctgggacacaatagattgactctatagatttaattttttttttttttttgagacagagtctcactgcaatctcagcttactgcaacctctgcctcacgggttcaagcaattctcctgcctcagcctcccaagtagctgggactacaggcgcgtggcaccatgcctggctaatttttgtctttttagtagagacagggtttcaccatgttggccaggctggtcttgaacgcctaacctcaagtgatccacctgcctcagcctcccaaagtgctgggattacaggcgtgagccaccatgcccagcctcaattcctctttctatctggtaatttttctgaagttgaaaacatttgttctaatacgttatttcagtgttcttctaagatgtgtaaagcaccctattcccaggtcagcccccatcttgctagtgagctcggctggttcttcacaagagctctggttttctcctgcttaatctcaagtacctctgtcagcctccacctggtttatgatttggagttttttggtttttgttttttgtttttgacagagtcttactctgtcacccaggctggagagcagtggcataatctcagctcactgcaacctctgtctcccaggtttgagcgattctcctgcctcagcctactgagtagctgggattacaggcgcgtgccaccacacccggctaatttttgtatttttagtagagatggggtttcaccatgttggccagggtggtcttgaactcctgacctcaggtaatccacctgcctcagcctcccaaagtgctgagattacaggcgtgagccaccgcgcctggcatggtttggagttttaatctgtagttttaataaagatagtgcttatgtttgtgtttcttatatttcttggtactcttgggtaatttgtaagatccccatatctacacaagaagtccattttcaattcttttcttcagactgtttattttattttattttattttatttttatgtttgagatggagtctcgctgtgtcacttctggaggctggagtgcagtggcgcgatctcaggtcactgcaacctccgtctcccgggttcaagcaattctcctgcctcagcctcccgagtagctgggattacaggcacctgccactttttaatttttttagagacagagtctcgctttgttgaccaggctggagtgcggtggtgcaatcatggctgactataacctccaaatcctgggctcaagtgatcctcctgcctcagcctcctgagtagctgggactacaggcacatgccaccatgcccagttaattttaatttttttgtagagacagggtctccatatgttgcccaggctggcctcctactcctggcctcaagtaatcctcctacctcagcctcccaaattactaggattataagcatgagccaccatgcccagccttgttctactactttaatttcatatgttaggtgaccatgtaattgatcatccaaaccaggatactgtaagaatgaaagaggctgacagtagtatgatgctgggactagcattgtgcactgagattatttctgggaaagcaggagatacggtcaccctacttatagtgtgcttgtctttggattgttgaatttggagtttctatttgcaggcttatttcaactgggcagccttgatccgccctgcccagcaatgctaccgttctctccaccgggtctctgggaccccttcagtcactatacttagctcagttccccaccctcccactccctaaaagcgtaaccaggaatcctgcctcaggtctactgccgtcttccgtgggctgtttcagttcctattacccagagtcaaactcccagcattccctacctgattccagacttggagtccagagctttaacctcttcaggccaactccccactttgcatttctgtccctatatcttagtccatggagatacatttcatgtctttgagtctacttacaaagtaaattttgctgttttttaattttttttttgagatggagtcttgccctgtcacccaggctgtggtgcaatgacgccatctcggctcactgcaacctccgcctcctgggttcaagcgattcatctgcctcagcctcccaagtagctgtgattacagacaggcaccaccacgcccagctaattttttttatcttttagtagagacagggtttcaccatgttggccaggctggtcttgaattcctgacctcgtgatctgcccatctcggcctcccaaagtgctgagattacaggcgtgagccactgtgcccagccaattttgctttttttatatttcattgctatatgtttagaggataagtttacagtgctatatgcattcccaaatattagaccaaaaaaatctccaaaaaattagaaagaaaatccaaaaaatctcaaaaaataccaaaaagcaacaatctcacagaccatactcactgacccccaataaaataaaattagaaattaaccacaacttaacaaaataaagtactcaagtcagagaggaaagaggaaataaacatcaaaattacaaagtctaggcggtggctcacgcctgtaatcccagcactttgggaggccaaggcgggcagatcacaaggtcaggaattcgagaccagcctggccaatatggtgaaaccccgtttccactaaaaatacaaaaattagccaggcatagtgatgtgtgcctgtaatccagccacttgggaggctgaggcaggagaatcactgaacccagggagacgaagattgcagtgagccaaaatcgtgccactgcacttcggcctgggtgacaaagcgagactccatctcaaaaaaaaaaaaattacaaactctttagatagaaattttggtgtttttttttgagacggagtctcactctgtcgcagaggctggagtgcagtgggactatgtcagctcaccgcaacctccatctcctggattcaagcaattctcctgtctcagcctcccaagtagctaggattacaggcgcccaccaccagacccagctagtttttatatttttagtagagatggtgtttcaccatgttggccaggctggtctcaaactcctgacctcaagtgatccacctgcttcagcctcccaaagtgctcagattacaggcgtgagccaccgcaccccacctagatagaaatttcaacatgaggccgggcacaatggctcacgcctgtaatctcagcacttcaggaggctgaggcgtgggaggatcacttgggcccaggagttcaggaccagcatgggtgacagagacagaccctgtctctatttatttgaaaaaaaaaaaaaaaaagagagagagaaagaaatttcaacatgaaaagtatctctcaaacccttcgagatgttggcaaaaagcgactcaaaggaaaatgtattactgtgtgtgaatttgcttgaaaataagaaagaggccgggtgtggtggctaacacctgtaatcccaacactctgggagtccgaatcaagtggatcatgaggtcaggagatcgagaccatcctggctaacatggtgaaaccctgtctctactaaaaatacaaaaaattagctaggcgcggtggctcatgcctgtaatcccagcactttgggaggctgaggcaggtggatcacctgaggtcaggggtttgagaccagcctggcctacatggtgaaacctcgtctcttctacaaatacaaaaattagctgggcgtggtggtgggtgcctgtaatcccagctactcagaggctgaggcaggagaatcgcttgaacccgggaggcggaggttgcggtgagccgagatcgcaccactacactccagcctgggcaacagcctgggtgacacagtgagactccatctcaaaaaatacaaaaaattagctgggtgtggtggcctgcgcctgtagtcccagctacccgggaggctgaggcaggagaatggagtgaacctgggaggaggagcttgcagtgagccgagatcccaccactgcactccagcctgggcgacagagcaagactcttgtctcaaaaaaaagaaaaaaaaaggaaaaaagaaccctgataataaagaaaccaaatgttcaactctcaaagctcggacactttaaagaaataattaataaaggcagaagttaaagggaggatgataaagcaattttttttgttggtttttttgagatggagtcttgctctgtcacccaggctggagtgcagtgatgcgatcttggctcactgcaacctctgcctcccgggttcaagcaattctcctgcctcagcctcctgagtagctggtactacaggtgcgcgccacctggcccagctaatttttgtatttttattagagacggggtttcaccatatttgttaggctggtctcaaactcctgatctcaggtaatctgcccacctcggcctctcaaagtgctgggattacaggcaggcgccaccgcgcctggcctaaagcaaaatattggttctgtgcaaaaggtcaataaaaagagcaaacgtttacaaactggagccagcacccattcagctcagtgtgtctggagaaaaaacaatctcgcttcagaattcatgattacgcagccctttttgcttcctaaaaatcctactatgttgctgttgaccattctctctctttctctctctcttgctttctctccagaaaagctattcagacattctcctctttcctcaaacctccaacacttcctcctccatccttagcctcagctgctgacctcacttctaatcattgagaaaccaggagaagcatttaagagtgaacctccgcctccccgcacgggcaaaaccacccacccacagaattgtgccccaattctgcgtcctctcctctcaccatggatggacggtccaggctccgagccaaagccaggcctcccctggagctctggatccaccacctgcagcttctcaggcagggccccagcagctcccctgctcccttgtaccatcaatccctcccctcactgggtcactcccaacaatatatatatttagtgatgtttctcccatgtggtaaaatcacttagcctctctcctcccccagctactatcctatttgtttctttccattctctgcaaaacttctcaaagcattgtgtctatgtgctgactccatttatcttctcccgttctctgctgagtccttcccacagactctcaccccagttactccatgaaatgacctctgcactgccacatccaatggtgaatgttcagttcttaattttattcagtctttcagcagcatttgacctggccgatcactccctcttcttaaaaatacttttctcagccaggcgtgatggctcacacctgtaatcccaacactttgggaggccaaggcgggaggatcatgagagcccaggagttcaagatcagcctgggcaacatggcaagaccctatctctacaaaaactaaaaagtagccagtgtgatggcatgcacctgtagtcccatctacttaggaggctgaggcagtaggatgacttgagcctgggaaatcaaggctgcagtgagccatgattgcaccactgcactccagcctgagtgacagcgagaccctgtctcaaaaagacaaaataggaaacttttctcagcatattcctctgattctcctgctgcttctgtctgcacagattcagtctcctttgccggttcttcctcatcctcctgatctcttgaccttgaagtgccccagagtacagtctttttttttttttttgagacgcagtctcgtctgtcacccaagctggagtgcaatggcgaggtctcagctcatgcaacctctgcctcctgggttcaagcgattctcctgcctcagcctcccaagtagccaggactacaggcacatgccaccatgcccagcaaattgttgtatttttagtagagacagggttttactatattggccacgctggtctcaaactcctgaactcgtgaaccacccgcctcggcctcccaaagtgctgagattacaggcatgagccaccacacccggcccagagtacagtctttagacggcctctctacctatacttgctcccctcataaactcctcctgcctcatggctttaaataccatcggtagactgatgactcccatatttctcttttttttttggagacggagtctcgctcagtcccccaggctggagtgcagtggcgcgatctcggctcactgcaagctccacctgccaagttcacaccattctcctacctcagcctctccagtagctgggactacaggcacccgccaccacgcctggctaatttttttgtatttttagtagagatggggtttcaccatgttagccaggatggtctcgatctcctgacctcgtgatccgcccatctcggcctcccaaagtgctgggattataggtgtgagccaccgtgcccagccgatgactcccatatttctatctcttgctgtgtgggagttctcctcagaactccatactcataaatccaactctcataaatagtatctcaaatgggcaatatgctcaaaagtcaattcctacttttctccctaaacttgctttcctgcagtctccaccatcttaatgtccaatctaacattaggaggcaaaaactttgaagtcattcttgactcttctctattacacaccctatccaatctttctgcagatccagtcgacccccaaatccagttagctctcatcatctcccctgttaccccctggtccaggccatcttcctctctcacctgaatcactgcagcattctcctcactggtctctttggttctgttttcactccaccttagcatagtctccacagagcagtcagagggatccttttaaagtgtaattcccatcctgtccctgctctgctcaaaaccctgtcgtgattcccgttttaatctgtcagattaaaagccagagtctttccagtgacctacatgatctgcctattatcacctcccacttctttccccttgctcactccactccagctctgcagctgtcctttctgtttcctgaacagcccagattttgcttctttagaacctttgtatttgctgtcccctctgtctggaatgtttttccaggaagtcacctggctctctcctgcacttccttcctgaccaccatgtttaaaaatcactcaaacacacttcaggccggacatggtggctcacgcctgtaatcccagcactttgggaggccaaggtgggtggatcacctgaggtcaggagttcgagaccagcctggccaacatggtgaaacttcgtctctactacaaatacaaatagtagccaggtgtagtggcacacacctgtaatctcagctactcaggaggctgaggcaggagaatcgcttgaacccagaaggcagaggaggtgcagtgagccaagatcacgccacaacaccccagcctgggtgacagagcaagaccccatctcaaaaaaaaaaaaagaaaaaaaaatcacacaaacacacttctcttcatattccttttccaagttttatttttctccagaatactttacattgttttaatggaagttctccgtttccccccaactagaatggatacttcctgcaggtaggcactctagtcctcccatccaagtactaaccaggctcaaccctgcttagcttctgagagcaggggagatcaggcctgttcagggtggtatggcccaggaattttgattctgttttattcattgctgttctgttgattctcttttgttcctcctcctagtgctgagaacactacttgtacataataagcattcaataaatatttgttgaatgaatgacttgttgaatgaattaatctcagaaatgcaggactggttctacattagaaaatttttcaaggtcattctctgttgtcgtaacacattaagagaggaaaattttgtactctaaatcatttgataaaatacatactgatttctgttttcaaaaactcttagtggctgggcgaggtggctcacatctataatcccagcattttgggaggacgaggtgggcggatcacttgaggtcaggagtttgagaccagcctggccatcatggtgaaaccctatctctactgaaaatagaaaaattagccgggtgtggtggcgcatgcctgtagtcccagctacctgggaggctgaggcaggagaatggcttgaacccgggaggcggaggttgcagtgagccaagatcatgccattgcactccagcctgggtaacagagtgagactccatctcaaaagaaaactcttagtgagtttaggaatccaaggaagaccctcaaactaaatagataatctagctaccagaagccttcagtaaaccttaacactccatggtgaaacattagaaacattcctactaaaagacaggctaagaatgcctgcaatcttcacggctagtccaagaagtcaaaaagaagaaatgagcgctgatttaaaaaaataaacaaacaaaaaactaccgatgcagaggctggcagcaaggactgaaggactgtacagtacttgcctggagcaggcggatggccacacccctgcgaagcctgctcagctggctgggggacgctccagtgtgtgagtggcaggatgcagggtacttcctctgccagggagttgcactggggagatcctcccccactcacactttggcagctggggctttggaatgtgacttagcttctgtcaaagggtcaatccaccctttgatatatgatgcaaaggcgaacatatgatgcaaaggtgagagaacagcccaaattaggacttttaccacagctgtggaggtggacagcgacagtggtgggccctggccagacttttcatgctcaaaggtggtggttgttcttcctacttcttgtccctccagggcttcctttgcctgtgtgctgaacctgcttcttttaattttttttaacttttttaaatttttaattgttttaattaaaacaaattttgaaaactgtctgaacctgcttttgaaccctgctatgatttgaatgtttgtcccctgccaaactgattttgaaacttaatctccaaagtggcaatattgagatggggctttaagcagtgactggatcatgagagctctgacctcatgagtggattaatggattaatgagttgtcatgggagtggcatcagtggctttataagaggaagaattaagacctgagctagcatggtcgccccttcaccatttgatatcttacactgcctaggggctctgcagagagtccccaccaacaagaaggctctcaccagatacagctcctcaaccttgtacttctcagcctctgtaactgtaagaaataaatgccttttctttatgaattacccagtttcagatattctgttataaacaatagaaaacgaactaaggcaaactctcatgattctactgccatgccattccaataaactccctttatgcttaagagagccagagttggccaggcgtggtgactcacgcctgtaattccagcactttgggaggccgaggcaggtggatcacaaggtcaggagatcgagaccatcctggctaacacggtgaaaccccgtctctactaaaaatacaaaaaaattagctgggcgtggtagtgggtgcctgtagtcccagctactcgggaggctgaagcaggaggagaatggcgtggacccaggaggcggagcttgcagtgagtcgagatcgtgccactgcactccagcctgggtgacagaatgagactccgtctcaaaaaaaaagagagccagagtttatttctgttgcttgcaaccaagaaatctggctggtgcactgaagtttccataaataatagcaatttaaagactctttccaagccaggcaatgcctagccttgtgtagtccttgtggtaatacattcattcattcatttgttcaaccaactgtgctccagagactaagaatacaaaaatgggggccgggtgtggtggctcacacctataatcctagcactttgggaggccgaggcaggtagatcacctgaggtcaggagttcgagaccaacctggccaaaatggtgaaacccctactctactaaaaatacaaaaaattagctgggggtggtggcggacacctgtaatcccagctactcgtgagactgaggcaggagaatcacttgaacccgggaggcagaggttgcagtgagccgagatcgcaccactgcactccagcctgggcaacaagagcgaaactccacctcgaaaaaaaaaaaaaaaaaaaaagagggccggggctgggcgcagtggctcacgcctgtaatcccagcactctgggaggccaaggcaggagaattacgaggtcagcagatcgagaccagcctgaccaacatggtgaaaccccatctctactaaaaatacaaaaattatccgggcgtggtggcgcacacctctagtcccagctacttgggaggctgaggcaggagaatcgcttgaacccgggaggcagaggttgcagtgagccgaaatcatgccactgcactccagcctgggtgacagagtgagactccgtctcaaaaaaaaaataaaaaaaaaaaaagaattcaaaaattgtagagttatagtgtgcttctagtttagttgagaggacatctgtccttcaaggaaggctagaatctataccctgagtccttactgaaatcaatccagcagtcaaaacatgggaccaacgatcacagcagtaagataggaagagcacctttgtacatttagctcatgttgagataagccactgacagagctgaaggaagctcacagttctgggttccatcctttggcatttaaaaagaaaagtgctaagaaaattcggttggtcacggtggctcacgcctgtaatcccaacactttgagaggccaaggcaggcagatcacgaggtcaggagttcgaaaccagcctggccaacatggtgaaaccccgtctctactaaaaacagaaaaattagccgggcatggtggcgcatgcctataatcccagctactcaggaggctgaggcaggagaattgcttgaacccgggagggggaggttgcagcgagtgagagcaggccactgcactccagcctgggagacagagcaagactctgtctcaaaaaaaaaaaagaaaaaaagaaagaaaggaaaaaaagaaagaaaaaaaaagaaaaaagaaaattcaggccaggccaggcctggtggctcacacctgtaatcccaacactttgggaggctgaagcgagacggtgccttagcccaggagtttgagaccagcctgagcaacatagcgagaccctgtctctataaaaaaaaatttttttttggccagacgcagtggctcacgcctgtaatcccagcactttgggaggccgaggcaggtggatcacgaggtcaggagatggagaccatcctggctaacacggtgaaaccccatctctactaaaaaatacaaaaaattaaccgggcgtggtggcgggcgcctgtagtcccagctactcgggaggctgaggcaggagaatggcgtgaacccgggaggcggagcttgcagtgagccgagattgcgccactgcactccagactgggagagagtgagactccgtctcaaaaaaaaaaaaaaaaaaaaaaaattaattgtcaggtgtgctggcatgcagctgtagtcctagctactcgggaggctgaggtaagaagatcgcttgagcccaggagttcaaggctgcagtaatagtgcctctcactctaccctgggtgacaatgagaccctctctcaaaaagaaagaaaaaagggaaagaagaaaagaaagaaagaaagagaagaaaggaaggaagaaagaaagaaaaagaaaaggaaggaaggaagaagaaaaaaaaagaaagaaagaaaagagagagaagttcaaagaccaaagggtcaggatcccaaaatagtttttatgttttatttatttatttacttatttatttttgagacagtatggctctgtcgcccaggctggagtgcagtgatgcgattgcggctcactgcagcctccaaactgggctcaggtggccctcccacctcagcctcccgagtagctgggaccacaggcgcgtgccaccatgcccagctaattttttaattctttgtagagatgaggtctctatatgctgcccaggctggtctcgagctcctgggcttaagccatccacccgcctgggcctcccaaagtgctgggattacagaagtgagccaccgcgcctaatcgggtggtttgtttgtttattgacggggtctcgctgctgcccaggctggagtgccagtggctgttcacaggtgcagtcctggagcattgcatcagctcttgggctctagcgatcctccagagtagctgcagctgggattccaggcgcgccaccgcgcggggctcagaatgggtttttatattgagggttatgctgccacctagaggatatatgtagtaccgaactgtgtgcgcagggaggctgaggttgcagtgagccaagatgatgccagggcactccagcgtgggtgacagagcaagatttcatctcaaaaaaaaaaaaaaaaaaaaaaaaaaaagaattgaaagtaaggtcttgaagagatatttgtgcctgtatggtcatagcagtattaactttgacccactagctaaaacacaaaagcaacatgtgtctgtcagcaggtgaacggataaacaaaatgtggtatatatgtacaattgaatattattcagcctttaaaaaggaataaaaggctggatgcgggggctcacgcctgtaatcctaacactttgggagactgaggtgggtggatcacccgaggttaggagtttgagaacagcctggccaacatggtgaaacttcatctctactaaaaatactaaaattagccgggcatggtggcacttgtctgtaatccaagctactggggaggctaaggcaggagaattgcttgaactcaggagccggaggttgcagtgagctaagatggcaccactgcactccagcctgggcaacagagtgagactccatctcaaaacaaacaaacaaaaaattattatttccaaagaaacaagaccctgggtccatttcccagcccacacctgatgttgactcacaacacacagcctggtttgctatgagcctgcttcatttaattgtcaccttaacttcacatcaccctcaagtcctggaataactctttgctgacctttgtgtgctgagccatctccatgtcgctcaacgtgcagtccctctcactgcactgagtcaatagccagacgtggtctgactgcagggtcatccttggtggcttaggctgactcgggcatagcagggtgctctgagacctcaccgcatataggctttgcccccaataaactctatataatattcatattatgtggtctgggtgtgtgtagctttgcactgtcttctcgtgacagtgccctcaacctctttcccaggatttcctcctctacctcctcaagtcccactgctctgcaaagaccaaaagctgcagagtcccagctccctcctttacaccccacgacgcagcctcctctctcagaaccctttaaacagagtcttttactgcagatcccaagaacagccacacccctctctcccacccactccagacacacccaggtaattatagcacccagggtaactatgtagatggagtccctggaacatgtggatagtgccccctgggagtatgcaaaagcaacattgctggcacctgcagagaacagggtgacatccaggaatcagagcatgggcctctgggaggtagggatgtggccaggcaggctgccaaaaattggtagagcaaggccacaggatctttctgaccttccttccaaacagaggctcctgtactggtgatccctgtgttgattgaccactcccttcctgggggtcgtggtctctgtcccagttgcccggacttctgtgagtgtcctactgaggtccttttcatgagaagcatgctgtccttccacctgctgggagcaagagtgacaacttcaatactataatagcagtggcatacagagaagaagaaagatgaagtggcaagaaaaacaggcttccaagcaggagtttttctataaaaacaaaaacgtttacaagcaaactttttataaagggctagatagtaaatattttaggctttgagagccacatagacttgtttgcagggactcaatgtcgctattgtagtttgaaagcagccatcagggttatgtaaatgagtgagtctgattttgtttcagcaaaattttatttaccaaaacagacaatgagtgggctggatttggcccatgatccttagtttgccaactcctgctttgggctcacccagatctgattttgaattctggctctgctactggttagctgcaggagcttggaaggctctctgagcctgtttcctcatctgtaaaattaaagcaataatttctaacactcaagagtgttacctcacgcctgtaatcccagcactttggaggctgaggcaggcggatcacctgaggtcagaagttcaagaccagcgtggccaacgtggcaaaaccctgtctctactaaaaaatacaaaaagtagccgggcatggtggcgcgcatctgtaatcccagctacttgggaggctgaggcagggatactgctagaacctgggaggtggagcgtgcagtgagtggagatcacacctccacactccagcctggccgacagagcgagactccatctcaaaaaaaaaaaaaaaaagagtgttagaaggttttgagataatgaataaaagatgccttgtgtatactaagtattcaacaactgatagctgcattggtctaattataacagtttagaagcgattgagtcaacaaatgctggatttgtcagggaggacttcctatcaggaggtagatcttgggctgagtcctgaagcaaagataggcattggatagaggagttgagagaacaccctaggactgttattattattattcgacacggagtctcttgctctgtcacccaggctggagtgcagtggcgcgatctcggctcactgcaacctctgcctcccaggttcaagcgattctcctgcctcctaagtagctgagactacaggtgtgtgccaccacacccggctaatttttatatttttagtagagacagagtttcaccatgttggccatgctggtctcgaactcctgacttcaggtgatccacccgcctcagcctcccaaagtgctggaataacagatgtgagccaccgcacccagcccagaaccatttttcaatccttggctctgccttttattagctgcaagatctcaggcaatttatttaacctctccaaagactcattttctcattcacaaaatgaggcaaataataatatctactatcccaggttgtcatgagaattaaatgcaacatgacatttaatgaaatgagaagtcccttggacattaactggctaaagtatgtgctcgacaaggatatcattttaggtggatacttagcatctcagaactgatgctcacaatggaatatcattgaaacgcattaaaattcattttaaatgattgtaggtagtgaggcaattgaaagaagaagacaagaggactgattataatgcttcaggctcactagtctccttttaggagggaaaaacaatttcaagttaaattttaggctctagatttttacccctgctgctcattagaatcacccagattgatgaaatcagagcccatctgaggctgtgtttttcatctccagaatgagagctgttgtggggattaagtttttgaaaaagtacatctaacaggtgatcgaaaatgatagtgatattattgcagtgatggtcattattgttgttattattatactgaaagaggcttcagttttctgatccataaagtgagggaattgcatgagaccattgctaagattccttctagctctgtttttttgtttttgttttttagacagagtctctgtcgcccaggctggagtgcaatggcatgatcttggctcactgcaacctccgcctcccgggttcaaatgatcctcctgtctcagcctccgaagtagctgggactacaggcacacaccaccatgcccagctaacttttatatttttaatagaggtggggtttcaccatattggtcaggctggtctcaaactcctgacctcaggtgatccacccgcctcggcctcccaacatgctgggattacaggcatgagccactgtgcccaaccccttctagctttcttgatcactgattctagggttctctgctgaaatatatttgagacatcctggataaaagatcatgcaagagctcccaatatggtattaataattgattctggaggcttagctactcctgatggattagacatgactcaactgcctctcttatgtgtacaacacaacaacacaaccaagaaaggttattctggcattccatttattcagtttatttacagcccttacttccagcagcacgttaaagatatggccagggccgggtgcagtggctcaagtctgtaatcccaggactttgggaggccaaggtgggcggatcacaaggtcaggagtttgagaatctggcaattcttcagacttagaagcaaccagctcgataacacagtcttgtgtgggctctccctctgtccctccctcgcttccctcatttctcatccctgcccctgagactgtgcaccttcacatagccctgccatgagaccttcatctcaggctttgctttctggggtaactgaggctaaacactgagtggccctaaaagaggattgggatttggaagttagattattcaccagagaacagactttgctgatgatcaggcccaggttgtaattgttgaaaaaaagagaggatgcatagtcttatctcatctcctagtcaaagtcaacaccatgataaataagagtcaaatcctgagatgtgaattggggacatttgagtggttaaccctgagaagcttgcaccttcagacccctcaatacccctgctccccagagaaggctggacattgacctcagcacaggcaggagccctgcaagatgccatttgtcctactaaagatggacccctccactctgtttctaggtaaataaccaaagtcaagtctccacacagcctgagcaagaaagtcagagcctgctacaggagaaaataccacactggccaaaggattcactagccctggccactgtgtgtgggaggaaccagggaatcatgtgtgggagtcaatgttgaagctgttggactgggggtggggtggaatataagcctggccctggggagtttttcccgtttgagggcctttacccacaactcaagatccagtgctatagcaggagatcccagagctagtcctaacagatggtcaggattgaacttggcctagagtaaaatgaggaggatagtgccagaactttctcaacatactattgaggaagaggtcagaaggcttaaggaggtagtgtaactggaaaggggtcctgatccagaccccaggagagggttcttggaccttgcataagaaagagttcgagacgagtccacccagtaaagtgaaagcaattttattaaagaagaaacagaaaaatggctactccatagagcagcgacatgggctgcttaactgagtgttcttatgattatttcttgattctatgctaaacaaagggtggattatttgtgaggtttccaggaaaggggcagggatttcccagaactgatggatccccccacttttagaccatatagagtaacttcctgacgttgccatggcgtttgtaaactgtcatggccctggagggaatgtcttttagcatgttaatgtattataatgtgtataatgagcagtgaggacggccagaggtcgctttcatcaccatcttggttttggtgggttttggccggcttctttatcacatcctgttttatgagcagggtctttatgacctataacttctcctgccgacctcctatctcctcctgtgactaagaatgcagcctagcaggtctcagcctcattttaccatggagtcgctctgattccaatgcctctgacagcaggaatgttggaattgaattactatgcaagacctgagaagccattggaggacacagccttcattaggacactggcatctgtgacaggctgggtggtggtaattgtctgttggccagtgtggactgtgggagatgctactactgtaagatatgacaaggtttctcttcaaacaggctgatccgcttcttattctctaattccaagtaccaccccccgcctttcttctccttttccttctttctgattttactacatgcccaggcatgctacggccccagctcacattcctttccttatttaaaaatggactggggctgggcgcggtggctcatgcctgtaatcccagcactttgggaggccgaggcgggcggatcatgaggtcaggagatcgagaccatcctggctaacacggtgaaaccccgtctctactaaaaatgcaaaaacattagccaggcgtggttgcaggtgcctgcagtcccagcggctcaggaggctgaggcaggagaatggcgtgaacctgggaggtggaggttgcaatgagccgagattgtgccactgcactccagcctgggtgacagagcgagactccgtctcaaaaaaaaaaaaaaaaaaaaaaatagctgggcatggtggcgcgtgcctgtaataccagctactctggaggctgaggcaagagaatcgcttgaacccagtaggcggaagttgcagtgagccgagatcttgacactgcactccagcctggtgacagagtgagactctgtctcaaaaaaaaaaaaaagaaaaaaaaagacagaaagaaagagcacagacagagtcacaggtatttgcagtaggaagctgtcaggttagagtgcacggaaatagaaagtatattttacacttacagcacatcttcgtttgattagccacatttaaaatactgaatagcaacgtgtggctatttagtattcactaaaatcttggacagtgcaagtctaaagaatccttgatccgtccggcatggtggctcacgcctttaatcccagcactttgggaggccaaggtggaaggatcacttaaggtcaggagttcgagaccagcctggccaacatggtgaaacctcgtctctactaataatacaaaaaaaattagccgggcatggtggtgcatgcctgtaatcccaggtacttgggaggctgaggcaggagaatagcttgaatccaggaggcgctgcagtgagccgagatcatgccatgccactactgcactccagcctgggcaacagagtgagactgtctcaaaaaaaaaaaaaaaattgttgggcgtggtggctcacgcctgtaatcccagcactttgggaggctgaggggggtggatcacctgggttctggagttcgagaccagcctggccaacatggtgaaaccccatctctactaaaaatacaaaaattagctgggcgtggtggtgggcacctgaaatctcagctactcaggaggctgaggcaggagaatttcttgaacccaggaggcagaggttgcagtgagccaagatcgcgcctctgcactccatcctgggtggcagagcaagactatgtctcaaaaaaaaaaaaaaaaatacttgattgtctggacattctgcagaacatcatatggagacactatgttgacgacatcatgctgattgtaagcaagaaatggcaagtgttccagaaacacagtcaagacacatacatgccagaaggtgagatataaactctactaagattcagtggcctgccacactggtgacatttttaaacctgctagatgtttgtgtagaaaaggatttaaccttgcccaaagaggggtctggcctttgtccccagctactggacataatctctttaaactcttgaaatatcattcctgatagaagtatttttgttttgactaggggccttgggccagccagatagcaacaatgtgatctgggttgggggctttggatcaggtggcatcagtgtgacctcctgagtggctagagactagaatcaaccacatgggcagacaacccagcttacatgatggaattccaataaagactttggacacaagggcttgggtaagctttcctggttggcaatgctctatactgggaaacccattctgactccatagggagaggacaactggatattctcatttggtacctccctgggctttgccctatgcatttttcccttgtctgattattattattattatgagatggaatctcgctctgtcacccaggctggagtgcagtggaatgatctcaactcactgcaacctctgcctccccggttcaagcgattttcctgtctcggcctcccgagtagctgggactacagatgcataccaccacacccggctaatttttttgtatttttagtagagacggggtttcacgttagccaggatggtctcgatctcctgacctcatgttccgcctgcctcggcctctcaaagtgctaggaatacatgtgtgagccaccgcgcccagcccccttggctgattattaaagtgtatccttgagctgtagtaaattataaccgtgaatataacagcttttagtgagttttgtgagcacttctagcaaattatcaaacctaaggatagccttggggacccctgaacttgcagttggtgtcagaaataagggtgctcatgtgtgtaccatgccctctaattttgtagttaattaactttcacaactttattattaccgcttacactcaatgtttattcacatttatccacataccacttattctagtgccttgcatcaaagactttctatctcatgtactttattctgcttgaagtaaatcctttaggatattcttttttttttttaaactttgcacatacatacttttattttttatttatttttaattttgttatttttgtgggtacgtagtagatatatgtatttatggagtacatgagatgttttgatacaggcatgcaatgtgaaataagcacatcatggagaatggggtatccatcctctcaagcaatttatccttcaagttacaaacaatccaattacactctttaagttattttaaaatgtacatttaattttgtattgactagagtcactctgttgtgctatcaaatataattttttttttttttgagacagagtctcactcagtggcccagactgaaagtgcagtggcacaagctcggctcacttcaatctctgcctccctggttcaagcgaatctcctgcctcagcctcccacatagctgggattacaggcacacaccaccatgcccagctaatttttatatttttttagtagagacgggttttcgccatgttggccaggctggtcttgaactcctggcctcaaatgatctgaccacctcagcctcccaaagtgctaggattacaggcatgagccaccacacctggccaaaatagaatattctttagtgaggtctgctggtgacaatttttttcttttttttgagactgagtctcgctgttgtcagcttgggctggagtgcaatagcacgatctcagctcactgcaacctccacctcccggattccagcaattctcctgcctcagcctcccaagtagctgagagattacaggcacccaccaccacacgcggctaatttttgtatttttagtagaaatgggggttcaccgtgttggccaggctggtctcgaactcctgacctcaggtgatccacccaccttggcctcccaaagtgctgggattacaagcatgagccaccacgcacagccaattttttccgtttttgtctgaaatcttattttgtgtcatctttgaaatatatttttgatggatataaaattgttggttgatagttattatcattattattattattttgagacagggtctcactctgttgcctatgctggggtgtagtaatgtgatctcggttcactgcagacttgacctcctagggctcaggtgatcttcccacctcagcctccctagtagctgggactacagatgcatgccaccatacccaactaatttttctattttttgtagagatgaggctttgccacatttcccaggctggtctctaactcctgagctctagcaatccacccaccttggccttacaaagtgctgggccatgactagccagcagttactttttatagcatattgaatatttaatatgaatcttctggcatccactgtaactgtttaaaaaatcagctgtttacttggcactcttttttttttttttttttttgagacagagtcttgccctgtcgcccaggctggagtgcagtggcgtgatcttggctcactgcaagctctgcctcccgggttcacgccattctcctgcctcagcctccggagtagctgggactaaaggcgcccgccaccacgcccggctgatttttttgtatttttcgtagagttggggtttcaccgtgttagccaggatggtctcgatctcctgacctcgtgatctgtccgcctcggcctcccaaagtgctgggattataggcgtgagccaccgcgcccagcctcttttttttttttttttagacggagtcttactctgtcatctaggctggtgtacagtggcgtgatctcagctcagtgcaacctccacctcctgcctcagcctgccaaatagctgggattacaggtgcgtaccatcacgcccggctaatttttgtattttcagtagagatggggtttcaccatgttagacaggctggtctcgaactcctggcctcaagtgatctgcctgccccagcctcccaaagattacaggcatgagccaccgcacccggccaagtagcactcctttgaaggtaatctgcttcccctacccctagcaatttttaacaatttttcttcatttttatttcctgaagttttgttattaataatctgtgtgcagatttctttgtatttcttttgtttgcagttcatagtgattcttgaattagtgtgttggtttctgttatcaccacaggaaaattgtcagccgttagcttttcaaatatttccttgctaaattctctcttctcccctttcggtacaattgatttgattaaaactaaaaccagggccgggtgcagtgactcatgcctgtaatcccaacactttgagaggctgaggcaggtggatcacctaagctcaggagttcaagaccagcctggccaatatggtgaaaccccgtctctactaaaaatacaaaaattaccaggcatggtggcacacatttgtagtcaggaggctgaggcaggagaattgcttgaatccaggaggtggaggttgcagtgagctgagatcccaccactgcagtctggcctgggcgacagagtgagatgagaatctgtctcgaaaaaaaaagttatgaatgtttgataaactatatttgttagaatgtttgttgtagaatactattcattgatttttaaacaatgttagattaaaccattcactggatttgtgataattaacttactgattttacctcactgatttgttgtaattaatacaactggtataaaaagactgtgacgaggccgggcatggtggctcccgcctataatcccagcactttgggaggctgaggcaggcggatcacctgaggtcaggagttcaagaccagcctgaccaacatggtgaaaccccatctttactaaaaatacaaaattagccggtcgtggtggtgcatgcctgtaatcccagctcttcgggaggctgtggcaggagaatcacttgaacccgggaggtggaggttgcagtgagccgatatcgcgccattgcactccagcctgggcaacaagagcgaaactccgtctaaaaaaaaaaaagaaaaaaaacacataaaacaaaacaacactgtgacggttcccaaaaattaggagcataattaaaggaactcctgataaaaattaattttatcttacatgtaaactaaaatgactttatgaagttaattcagaaatacaatgcagggtattagtttgccacagctgcgtattcagcctaatgtaatattcttgttatttttaaattcttcttttaactttactcatatgtggatcatcaaatttcaaaagattaaatgacaatactcttagcagcaagcttccctaagcatataaacattttaatgggtgatgattcagaaggtacccgaagaatatgtactgccagatatcattcacccccatatacctgcccgacagacatcccattttgggaccctggataaatgtgtgggtggagagaaagataggagaaagtggtataagcaaatggctttggagtctgattgacagcgattgaaatcctgtctctacctcttaacagcctcatgatcctacataagttaccccgatcctcagggccacatctgtaaattgggggttgcgatggcagccatctcacagggtctcttttcggggaagggcaggaattatggattaagtgagctagtaattgtaaagcacttaatacaaggagggcgcataataagtacttcataaataatgacggccattatcatgactgaggtgtatgcagctgtcggggattacggcgacttcagaatttctggtgggcagggctcaaaggcagcaaatcacactggaagtcgaggtgaggcactgcttctgcacagactgcttagctggagagaatgaggaaggcttagaggagatttagaggaacttagagtcctccgcctccaactctgtgggatctgctcccgtgccagagacattcaggggatttctcgcactctcccctcccctacgtccctcccgccccatccaactaaccacacaacacatacaaaatagcccctgcgaggttctgcacgctggaagggaacaggagaagggcgctgcgctttcttgctgatgccctgtacttgggcccctggtagacacagccacttgtcccctcagcctgcagagaaatcccacgtagaccgcgcccgggtccttggcttcagccaatctccctttggtgggggtgggatgcacgatccaaggttttattggctacagacagcggggtgtggtccgccaagaacacagattggctcccgagggcatctcggatccctggtggggcgccgctcagcctcccggtgcaggcccggccgaggccaggaggaagcggccagaccgcgtccattcggcgccagctcactccggacgtccggagcctctgccagcgctgcttccgtccagtgcgcctggacgcgctgtccttaactggagaaaggcttcaccttgaaatccaggcttcatccctagttagcgtgtgaccttgagcagttgactttatttttcagtgcctagttttccagataccaggactgactccaaggactattactcatctggagggtttagcacagtaccgtcgcatagtaaatttccatgtcagttttggttacctttcatgcacttgcaaacatgccatgctctgaaacgaaataggcacatcttttttttttttttttttaaggagtcttcctctcgcccaggctggagtgcagtggcgcgatcttggctcactgcaacctccacctcccgtgttcgagattctcctgcctcagcctcctgattagctgggactacaggcatgccacgacgcccagttaatttttgtatttttagtagagacggggtttcgccatcttggccaggctggtctaactcctgacctcaggtgatctgactgcctcagcctctcaaagtgttgggattacaggcataagccactgcatctggccagaaatgaaataagtaaatcttttaacctgctctaacaatatagtgaaaagaccatattattattagagcaggttaagggatttgcctatttcgggttctagttatagtcttaaacttggacattcttgtagaaagtaaaaagtttcctcttcaaagttccccttcttgttaaagaatacatcataagtgttagaagtaatagtttattttaaagactaactttcttcaagcctccttgctttgtgctaataactctttgttaagccctatcctatgtaactgttggacatgctcacaggcacgttccagttcacagcctatgccccttccttatttggaaatgttattgcttccttaaacctttcggtaagcaacttcctctccttcttcgttcttccttgcacttacctatttagaaagttttaggctattagcaaatcggctatcagtttaagagtgtgaggtcccgctccagccaatggatgcaggacatagcagtgaggacgacccaaatgcgtaagggataaatatgtttgcttttcctttgttcaggtgtgctctcgacatcgttccatctgcgattgagcaccctttctgcagaaagtaaagattgccttgctggagatcttttgtctccgtgctgacttttcttcgtggcaccgattatctatttctaacaattttggtatttctaacattctgaacaatcttgggctagttgtctcttctgggcctgtttccccatccgtcacatgataaacttcattggtttaaaaaccccagcgaacatttattgagttactattaccttcctgccctccccaaccccaaccccagggagcagttacaacctcagccgctgagcgcactcgccgggtgttaagaagcaccaaagacagggaggcttgattgattttgctttgggagtagagggtcagaagattcacaggaaaatggcatttgagcaaggatgattcactggagctagcttttaaatactggcgaggcttttatgttgcagtcccttacaaagttgagcattcgcagggactgcactccgaaataagcccgcttccccttttcattcgctaatgatccagggagctgctggttccgcatgcggcaggttgtgccttttcctaatcagggttctgcatcgcctcgaacccgcaggccgtggcgggttctcctgaggaagcagggactggggtgcagggtgaagctgctcgtgccggccagcgcctgtgagcaaaactcaaacggaggagcaggaggggtcgagctggagcgtggcagggttgaccctgccttttagaagggcacaatttgaagggtacccaggggccggaagccggggacctaaggcccgccccgttccagctgctgggagggctcccgccccagggagttagttttgcagagactgggtctgcagcgctccaccgggggccggcgacagacgccacaaaacagctgcaggaacggtggctcgctccaggcacccagggcccgggaaagaggcgcgggtagcacgcgcgggtcacgtgggcgatgcgggcgtgcgcccctgcacccgcgggagggggatggggaaaaggggcggggccggcgcttgacctcccgtgaagcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaaggtagctgagggggcgccggcggggagtcaggccgggcctcaggggcggcggtggggcaggtgggcctgcgagggctttccccaaggcggcagcaaggccttcagcgagcctcgacctcggcgcagatgccccctgagtgccttgctctgctccgggactcttctgggagggagaaggtggccttcttgcgcgaggtcagaggagtattgtcgcgctggttcagaagcgattgctaaagcccatagaagttcctgcctgtttggttaagaacagttcttaggtgggggttagtttttttgtgtttctttgaggaccgtggatcaagatcaaggaaatctctttagaaccttattatggaagtctgaagtttccaaatgttgagggttttatgtctaaaagcaacacgtgaaaaaattgttttcttcacccagtgctgtcttccaatttcctctttggggggaggggtagttactgctgttactaaaataaaattacttattgctaaagttccccaacaggaagaccactacttttgatgactttggcaagtttgctaactactggaaccctaacttacaaacgaactacttacatttttgatttccagttgtattacctgcccaatgtttacgtagaaacagcttaattttgattctgggtaacgttgttgcacttcattaaaaatacatatccgaagtgagcaagtatgggtctgtggacagcagtgatttttcctgtcaattcctgttgcttcagataaaatgtaccagacagaggccgggcgcggtggctcacgcctgtaatcccagcactttgggaggcttggcgggtggatcacctgagatcgggagttcaagaccagcctgaccaacatggagaaaccccgtgtctactaaaaatacaaaattagccagggtggtggcgcatgcctgtaatgccagctacttgggaggctgaagcaggagaatcgcttgaacctgggaggcggaggttgcggtgagccgagatagcaccattgcactccagcctgggcaaaaagagcgaaactccgtctcaaaaaaaaagtaccagacagaaatgggttttgttttctttttttgttttgagacggagtttcgctcttgttgcccaggctcgagtgcaatggcgcgatctcagtctcggctcactgcaacctctgtctcccaggtttaatcgattctcctgcctcagcctcccaagtagctgggattacccatgccccaccatgcccggctaatttttgtatttttagtagaaacggggcttcaccatgttaggctggtcttgaacccctgacctcaagtgggcctcccacctcggcctcccaaagtgccaggattacaggcatgagccaccgcggccagccagaaatgggttttggaaaaagcactaaacaaaatcgaacttggtttcatatgacagctctgctgctaactgtaacaggggcagaccagttaacctacttttctgtcttctgtcagctgagaattagatgattcccaaaggcccattgaactctgaatgactttaaatacttcttcttaagtgggtacacggttttggtaactgatgccaggtgatgaatgcatgaaagtgcttaatgaatgaaaccggtaaaatagtaggaggaagctttattggtaaggcaggggtatacctaatagctctctaatttattggtattgaagtggttaacttttgtttttttaaggggggaaaacattctaagaataatgaggcaaactgcatattgcacaagagactgttgtctctattcaacaaataccttttgagtgtccagagtctgccaggtgctgtgctaggccctcacgattgagtagtgaaccagagaatgtccctgcacccatggagcttattgtctactggggtagacagataataaataagcaaacaaatcttctctcttctccctttcgctccatgtaagtgtgtgtgtataggtgtatacttacaagttgagtaaagtgttatgaaagattaagaggagaaatgcattttggttagatgttagaggactcagcaggtgaccttgaaacttagagctgaaggatcagtaggaggtaactagagaggccagggaatcgcatgttcaaaggccaggaggcaagaaagagcatggtgcccttcaagagaggaaagaaggctactgtgactggagcatagatgtaggcaagtgttgggtgattgagagctctacgggccatggttaggttttattcctaatgccgagatgccaaacatggtggttcatatctgtaatcccagtattttaggaggccgaggcaggaatatagcttgaacccaggagttcaagaccagcctgagcaacatgagacctgtacaaaacatttaaaaaattgctgggtatgatggtgcacacctgtggtcccagctactcaggaggctgaggcagaaggatcacttgagcctaggaggtggaggctacaatgagccatatttgagtcactacactccagcctggatgacaaagtgagaccatgtgtcaaacaaaatacagaaagaatattaatttaaaattttgaaagaggagtgatctgaacttatatcttaaaaagatcattctagggcatggtggctcatgcctgtaatcaagggctttgggaggctgagacaggaggatcacctgaggccagttcgagatcaacctgtacagcatagagagactccatctctacaaaaagaaaaaataaatagctgggtgttgtgagttattcaggaggctgaagcagaaagatcacttgagcccaggagtttgaggctgcagtaagctatgatcccaccactgcaacacagtgagatcttgtctcaaaaaaaaaaaaaaatcattctaggtgctttttggaggctggatgtggtaagagtagaagctggagatggtcctgttagggattcgattcagactttaaataccatcaatgcattgagtcccaaatttacatcactacgttggatccttgcccctgaatccagactggtatatccaactttaggttcagtttgtatctctacctgaccaatatagaggtgtccagtcttttggcttccctaggccacattggaagaagaattgtcttgagccacacatagagtacactaacgctaacaatagcagatgagctaaaaaaaaatcgcaaaacttataatgttttaagaaagtttacgaatttgtgttgggcacattcagagccatcctgggccgcgggatggacaagcttaatccagtagataccttcaacttacaatatctaaaattttatgccagatttagtcattttaaacctgctcatcagtttttctcaagaagtagtattttggctttttttcttttcttttttttgagatggagtttcgctcttatcgttcaagctggagtgcagtggcggatcttggctcactgcaacctccgcctcctgggttcaagtgattctcctgcctcagcctcgcaagtagctggaattacaggcatgcgccaccatgaccagctaatttttggagacagggtttcaccatgttggtcaggctggttttgtactcctgacctcaggtgatctgcctgcctcggcctcccaaaggctgggattacaggcatgagccaccgctcccggctgcatttttggatttttagttgctcagcccaaaactttagtacatctttgaacctcttctttcctcctactctatatctgatccatcagcaaatctgttaggtctacctcacacatatcgaaatcctaccacgtctcaccatctgtgacaattaacaccctggtctaggcagtcatctctgttaagattgagtggttaaggatgtcctctaaggagatgacattcaaatcttagcttaaatgtcaagagggagctggttttataaagattgaggaggcagcattattttgccataggcttccatttggtttccattccattcttgatacttatggtatatattcaaaacaaatgcacagaaacagacccaggtatattgggaatttcggatatagagttcctagttgggaaaagatagactgatctgtaaatgatgctagttatccatcatctggcaaaaaataatttcctgcctcctctcatatatctcagatcaacagactttttctgttaagggccaaatcataaatattttaggctttccagaccatatggtttctgtcacactctcctttatccttgaagccatagacaatatgtaaacaaatgggcatggctgtgctacgataaaactttacttacaaaaactggtagtgggccagtttaggcatggccagcactttgggaggctaaggcagatggatcacttggggtcaggagtttgagaccagcctggccaacatggtgaaaccctgtctctactaaaaatacaaaaaatagctgggcatggtggtgggtgtctataattccagctactctggaggctaagacacaagaatcacttgaacccaggaggcagaggttgcagtgagctgagatagcaccactgcactccagccagggtgacggagtcttaaagcaaaacaaaacaaaaggtagtgggttgtatttggcccatgggctgtagtttgccaatccctgatgcagaaacaaattccaggtaaataagagcctggaatgttaaaaaaacaaaacttgaagtcatgtagaagaacaggtagggggaacaatcctgatctcaggataggaagggatattgcttaaaataagacacaggaaaatataatccatgttgtgtaaatttgactacgttaaaacttaaaactttcgccaagcgcggtggctcacgcctgtaataccagtactttgggaggccgaggtgagcagatcaccaggtcaggagattgagaccatcctggctaacacggtgaaaccccgtctctactaaaaatacaaaacattagccgggcgtggtggcgggcgcctgtagtcccagctacttgggaggctgaggcaggagaatggcctgaacccgggaggcgaagcttgcagtgagctgagatcgcgccactgcactccagcctgggcgacagagtgagattccgtctcaaaaaaacaaaacaaaacaaagcaaaaaacctaaaactttcatacaataaagtatacctaagatacttctagaagagaagatttacatccaggacgtgtatggaatttctgcaagtaataagtaaaagacaagggacatgaagaggcagttcacaaaagaggaagccaaaatgaccaataaacatgaaaggatgtttaacctcaaaggaaacaaggaaatgaattaaaaacatcaaatgccatttcaaaactagtaagttggcaaaattaaaaataccaaggatgagaatatgaagcatggctatatgagtgcatggaatggtacagtcactttcattaaaaatgcacataatttgttttttatttatttttttgagacagtctatgtcgcccaggctagaatgcagtggcatgatctcggctcaccacaatctctgcctcctgggttcaagcaattctcctgcctcagcctcctgagtagctgggattacaggcacatgccacaacgcccggttaagttttgtatttttagtagagacagggttttgccatgttggccaggctggtctcgaactcctgacctcaggtgagctgcttcccaaagtgctgggattagaggcgtgagccaatgctcctggctgaaaaaaatgcacataatttgttacctagcaattccatgtctagaggcttatcctagagaaattcttgcttatatgcataggaagacgtgtactagaatgttcactagttgaatgtttaagtgaaaattaggaaataaagtaaatgttcattaacaggaaaatgagtaaaggtatatttataaaacaattaagtagctaaaatgaataaactagagctgcgtgaatgaactagaactggttcaatagtcatgtcagattattgaatgaatacaggtcagatatgtatagagtgtcatttgtgtaattaattttttttttttttttgagatggagtctcactctgttgcccaggctggagtgcagtggcgtgatctcagctcactgcaacctccacctcctgggttaaagtgattctcctgcctcagcctcccgagtagttgggattacaggcatgcaccaccatgcccagctcattttcctatttttagtggccacagggtttcaccatgttggccaggctggtcttgaactcctgacctcaagtgttccacccaacttggcctcccaaagtgctaggattacaggcgtgagccaccgtgctcagccatttgcgtgatttttaaagatgtgcagaataatgccattaaaaaaaatacacatacatgtatatatatacacgtttggctgggtgtggtggctcacacctgtaatcccagcactttgggaggctgaggcaggaggatcacttgagcccaggtgtacaagactagcctgggcgagatagcaagaccccatctcaacaacagaaaggataattaggtatggtggcatgagaggatcacttgagcccaggagttcgagtgttatcaggccactgcactctagcctggacaacaaagcaagaccgtgtctcaaaaaaataaaaataaaaagtatttgtatgtggtcatagtcaaaaaacgtacatggaaggaaaatgtctttatttatttatttatttttttttttttaagacagagtcttgctctgtcacccaggctggggtacagtggtgtaatctcagctcaccgcaatctcggcctcccgggttcaagcgattcttctgcctcagccttctaagtagctgggactacaggtacccgccaccacaccctgctaattcttgtgttttcagtagagacagggtttcaccatgttggcaaggctggtctcgaactcctgaccttaagtgagccacccgccttggcctcccaaagtcctgggattacaggtgtgagccactgcgcttggccaggaaatatctaatttagtaagtatttatatctgggaaaggaagggtcaggtggtgattcataggaactctaaagtctatgtataatacttagggggacagaaggaaataaagcaaaatgctgatatttgattgttgagttgtgtatatgttagaagtataacataggagatctgattgatagtaggagaatgtttttaggtggtaaaagtggaaccgtggtggtttgttttggcagtagaatcagttggtcatagtttgtatgtggaaggtaataaacagaccatgttaaggatgacttccggaattttggtctgagtagtgggtggatgacagtgtcattcatgagggaagatgaagactgaggtaggaacaggtttgggagaagatgacatgttcccttttagacaagtggaattatggaagatggcaggtaggtggttagctatatgaatttgagataaaagatttaggatggagatataaatttaggagtaacagcgtatctatggtattgtaagccttaagaatgggtaggatcagccaggaaatacagatgtatatgcagaagagaggagtcaaggaagccaagacaagttaatgtttaaagtgagtgatgtagtccatgggcagatgctgctgagagggctgcaaacaccagtgaccctacaacatttttaaatgtcgtcttcctgacagcagtgatcagtacctgcaacgatcttatttatttttttcatgttagtctccacacacttgaatgtagactttttgaaggcaaaatcattgccttttctgagctgggagcatgtctggcacataccaagcactcaacagttgatgtattgacttcatccagatactctgagggcgagttatttcctgctactagcctttcacctttcaatgtttaagagcacaaatacagagatgggcacgttttggcatttcttattttgataaccttttcctggtaagattttttaatgttgaaaaaaaaaaacaagaaaagagggttaaaaatagtcttatgtcagatcctgtgatagaattcacacttggcttaagctgctgggcaccttcctatcttggatgtcatattagcttatctacagcagaatttttactgttttatgtagtaaggaagcaattatatgattattttacagacaaattattctttatcttttatttttttagacggagtctctctttgtctcccaggctggagtacagtgtcgcgatctcggctcactgcaacctccgcctcctgggttcaagcaattctctgcctcagcctcccaagtagctgggcttacaggtgtccgccaccacacccagctcattgttttgtatttttagtagagatggggtttcaccatgttggccaggctggtcttgagctactgacctcaggtgatccacccgccttggcatcccaaagtgctggaattacaggcgtgagccaccgtgcctggcccagacaaattattatactctgagtgttagaggcttaggatgttttcacttgatgctatgggaggaataagtaataagatatgatacacaaccaaagacctttcttcactatgcttctagtagctagtactatggatgacacatggtaataatattggttagcatttgtcctcaatttactgtgctagttactcttctaagccccttacaggtatatattttttttcatcaataatcctctaaggtagtttttattattgacctaattttataaatcaagaaaattaagacccagagaagtaagtaacttgtccaagatcacatggcttataagtggtagagccagaatttgaccccagatgttgtgactacattgtctctccataagcaggttcaactcttttgactggatgctgttccaaggtcacttccttagagaagcctttgctgacaactaccctcctgtgccctcctccaaggctgtccattgttctagaactttgaatactcatcttagaataaagctggtctaatttttacagtgttatagaatggatctctgactgcaaaagttggtcataattatctttttatgttctagtgaaaggcaaagaacaagagaagacctcagatgtgaagtccattaaaggtaagttctgcccttggcagtccactgcattaaaaagtgatgtgctttgcatttgtgagttctttaatcctgttatactctctcttttggcattaatcatttctgccttattttataattacttatgattttgatttatttccctctttaacctgtataatgctttaacatctagcatataataagtaggctttttttttttttttttttttggagacggagtcttgctctgttacccaggctggagtgcagtggcgcgatcttggctcactgcaagctctgtctcccgggttcacaccattctcctgcctcagcctccccagcagctgggactacaggtgcacggcgccacgcctggctaattttttgtattttttagtagagacagagtttcaccatgttagccagtatggtctcgatctcctgaccttgtgatccgcccgcctcggcctcccaaagtgctgggattacaagcgtgagccaccgcacccggccgtaagtaggctttttttaccttaattttatttttttgagatggagtcttgctcttatccccaggctggagtgcagtggtgccatctcggctcactgcagcatccacctcccgggttcaagcgattctcctgcctcagcctcccgagtagctgggattacaggtggccgccaccatgcccagctaatttttgtatttttagtagagacagggtttcaccgtgttggccaggccagtctcaaactcctgacctcaagtgatccactcgccttggcctcccaaagtcctgggattacaggcgtgagccaccatgcctggccataagtaggcttttactgagccttgtgtgtattggctatcctagtgattacagtgaaccagtgcccttcttattaatcacacatttaattgttccctaaaagtgattagttcactttatttatttagtaagacaaaaaatgaagaatactcttaactgagcagtctgttaactgtaggaaagcactgacacttataaggcttagttttctgtcatttatccagaagtatggttgattacagtttttacttttttatttgaatgaacaaccttaatttaaaatatattttgtttattttttgttgggatcgatacattgtccttgtttatagattagagcatgctttttaaagatgctgtattactcactgattttatttgtccagtgtacagagattgaagtgggaaaattataatggaaattgtttccatagtcattacatattaatttcatcaatttatttccataaaatctgtagattgctacttatttagatttttccttcaaatgtttttatgttgtattgcttgcactgagtatttattctatatgctcaatttgctggagaagaagactaattataacttaggcaagttgtaaaattagggaaaaaagtaaggtaccttacagcctagtttacttatttcttatgtaaagccagttagattccacattagttcaaactgccttctttgagcaaaacttgattggcagtgataaaggcttaaagcccttctcaagcagagacctgtaaagactagatctgactgtagtagaaggaaggaacttagatgtttcaggcagtgagaacaccagtcttccactctaaactttgccactaacagtatgaccttgggaagttgtaactttcttcagattcttcatttgttgaatggggggattggcctagctaatttctaaatctctactgggctaaaaaattctgtgcttatactctgattatgaagtacataatctgtgcttaacattcactgacttatccttaggataatacagaagcagtacaagaaacagcccctcaagatgtttgcagtctggttagaaagacaaacttatacacagaacagtagcaaatagaccaaaataataatagctgccatttatagaacacttcttctgttctgggcattagacaaaaactgactataacggtgaacaaaaaagacttaggtcctgccctcattgaacttacagattagtaggggagaggaacattaatcaagtaattccacagatggcttagcctagattggtagtgatggaagtaaagagatgtgaacggacttgaaaaaaaattcggaggcaaaatggatagaagtttattattgattaaatatgaggtgtgagagagagggatatttaagattgatacctaccttctggcttgcctaacagaaccaaaacaggaaattatatgttcagttttgttatgttgggtgggaggtgcttttgagtcattcatttatatatgttatatatgttattttatatgcatagtaattttaaggtctgagttttaaaccaaaggttagagagtgattttttagagtctagcaaacctaagttgaaatcctgcctgttgaaatggctgtttactagctcattaacctagggcaaagtattcaacttgttttcatttttgtcttcatctctaaaatgaggaaaatatggtcttacaagattgtcctgagagatagatgaaataatatccaaaaaaaaaaaaggtacatagagaaactcgtatagtgcctggtatatagtaggtcctccattggtagctatcattatctagttttaacatagccttcagtttgttgaattagtcaaactgagtgaagcactgcaaggaattcagaggaatttgagatcaacaaatgatttctgaagtttagggaagacttcatggcaatgacacttaccttgtataaaagttgaagaataagaaagatttgaatgagagattctttctcttctccctaccagcccagcttcttatttgaggatatattgggcaaaggggccttcagacaagtagagggagatttttacagaaagattgagatgaaggtatagaaggctgtaaagaccagaaaagagaattgagacagaggaagcaggaagccactgtaggtttttgagcaagatattgatgctgtaagtatggtgtttatgaaaggttagtctggaagagatttgcaggatggagaccccggaagtttttttgttataatacagaaagacttgcactgagggtgaggtgttaaaaataaacaggtaagtaaatgtttaaacatcttgaaggaaaagtcaacaaatcttggcaagtaaacagataacagtgaaaaagaatgggaccaagattttgagttttggagactggtggattgaacagacagggaaattgagaggagaatcagatgatgatgttttaagttgatatttagacagattgtgcttgagatggtaaagtcaatgtgggtgggaatgcttagtagcgagtaatcagtgatacaagaccaaagcccaggtcaaagacaagtcacagatacagatcagggctttttcatctgctccacagaggtgtaccctaggagctgttgcaaacagtccatgtggagggtgtgagtaagatgtttcccttgaatttgccagaattacttttttgttgttgttgttgttttttctgagacagattctcgctctgttgcccaggctggagggcagtggcgagatcgcgcagctcactgcaacctctgcctctcgggttcgagtgattctcctgcctcagcctcccaagtagctgggattacaggcttgtgccaccaagcccagctaatttcttttgtatttttagtagagatggggtttcaccatgttggccagactggtctcgaactcctggcctcgtgatctgcctgcctcagcctccaaaagttctgggattacaggcgtgaaccactgcacccggtcccttgttaagtttattttggtgggaagcaaaggaggtttcagcttttaaaaagtttgaaaattattgctctggtaataattaaagatttgagagtaaatatgctttctagcagaaagaataaaagaagaacagatagcctcaagaaggggagccaaagaagcaggctatatctgacacactgggtgttgataaatgggtattaaaagaatgagagcaatgagcagatagaagaggaaattaggagagtataataccatggagaccaagaaagatagactatcaggaaggagtggtaaaaataagttactagttctaagagagatgttaagagggaccggggaaagccttgtacaaatgagttagtagcattttacattatatacatctaattaagaaacaatgcgagagtctcaccattcctatagactcttacttgtacttgtctgaacacgaaaactggcttttgtttataaataagctaaaaattattttgctccaatttctcatgaaaataaaaataaaccttcttttaacattgaaaaaatagtttgaagacagtcactcttcattttgtaattcccacaactattattgaatgactgaaattatctttattctgaagccaaaggggtgatactgatatttcttcagactactaaaaatatattttatgaatttttagtgtgctttatctttttttgtttttttttttgagatggagtttcactcccgttgctcaggctggagggcagtggtgcaatctcagctcactgcaaccttcgcctcccagattcaagcaattctcctgcctcggtctcccaagtagctgggattacaggcacctgcccccacacccagctaattttttgtatttttagtagagacagggtttcaccatgttggtcaggctggtcttgaactcctgacctcaggtgatccacccaccttggcctcccaaagtactgcgattgcaggcatgagccaccatgcctggcctgaggaatatttttctaggttccccccaccccaagcatttattctgcaattttagttttgttcctaaagcaagcaaggtttaaggatttaaaaataatccgtattttagaatgctttctggctttgttactttttatccacagtagaagttctcagagaatgatctccctcttttaatttaactttttggcacagtattttgagaattataaataatattagaatgttttctggctgggtgtggtggctcatgcctgtaatcctggctacttgggaggctgaggcaggagaatcacttgaacatgggaggcagaggttgcagtgagccgaggtcatgccactgcactccagcctgggtgacagagcaagactctgtctgggaaaaaaaaaaaaaaaaaaaagagtgttttctttcctattttccaccacttgattaagttacttttcctcttaagtattttttgctgagtatgctgacttaagagtaatgttacaaaatttaatttttaaagttctctgaaagcccctttatgagagttttaggctatcaaattgtgtttaattcttaacaattttttgaaaaattatagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggtaagtaactatcattttttattaacttgtattagaaggatttgagtacaatatgtgaaacttctgtcataggatacagaactatataattggaaagtgctttggaaaaaatgtatttaaaataacagctacaagtataatgggtagctgtgttgtgttcctgtaaatatagaatataaagcatgcccagtagaaaaacaagcatttccagaagaaatatatctgatcactaaatataaatatatgaaaaagatgtctcactttattactgagggaagtgcaaattaaaataatcagttaatgttctcctaacacattagcatattttttaaagtttgacaatttgaatgtcagtgaagatgcagggaaatacccctcctatttagtgataatataatctggtgaagactctttggaaagcaatttggaaatcagtataaaatatgcatgtcatttaggccactctttctaagacctagccctcagatatgctcattcatatgtgcaggtgtgtatgtgtgtgtgtgtgtgtgtgtgtgtgtgtatatgtatgtatgtatgtatgtatgtatgtatgttgaaggctattcattatagtattgtttgtgatagcaaaaaattatggacaacatataaatatctgttatagggaaataaccaaattgtggtatacgcatgctctggagtataatatagccatttgtttctatttatttattttcttgagacagggttttactctgttgcccaggctggagtgcagtggtatgatcatggttcactgcagccttcacctcctgggcacaagccattctctcgcctcagcctccagagttactaggactgcaggcatgtgtcaccacacccagataattttttaattttttgtagagacagggtctcactatgttgcctaagctggtctcaaactcctggcctcaagcaattctcccacacaggcctcccaaagtgctgggattaccaacgtgaaccaccacacctggttcagtgtagccatttagaaatctaaaaaagacgtgggaaaatgtctaaggcatgtttaaatgtgagaaaagcaagtcacagtatgcatggtaaaatccgttatattaaaataagttcttccaaaacaaaaacatatgcaggagacctttattttgtcagtatttcttacccaaatttctgcacttagaaaattgcatgtcatgttgtcataagttgaaaaaaagatccatgaaccaatggacttctaataaaatcagtcctgcttttgacatctctctctacttttgtgtatattcaaaccagagtgtcaatgtgtttgtggggcacacttagcaataatacatagcagacaaaatgcatatagctcagagagtaaaattgtaagttttgctagatcactcataaattgctgatgagaatttaaaatggtgcagatgctctggaaaacaggcagtttctttctttctttttttttttctttttgagacagggtctcactctgttgcgcaggctggagtacagtggcgtgattacaactcactgcagcctcaccctcctcaggttcaggtgatcctccctcagtctcctgagtagctgggactataggcatgcaccaccacgcctggctaatttttgtattttttttttttttttttgtagagacggggtttcgccatgtttcccaggctggtctcaaactcctggaatcaagcgatccacttgcgtaggcctcccaaagtgctgggattacgggcgtgagctactgtgcctggcctaggcagtttgtttgtttgtttgtttgtttgtttatttatttgtagacggagtctcacaggctggagtgcagtggcccaatttttggctcactgcaacctccgcctcccaggttcaagctattctcctgcctcagcctcctgagtagctgggatgacaggtgcctgccataatgcctggctgatttttgtatatttagtagatatggggtttcaccatgttggtcaggctggttttgaactcctgacctcaggtgatcagcccgcctcggcctcccaaagtgctgggattacaggcatgagccgtcatccctggctggtggtttcttatgacgtgaaacatgcaattaccatatgacctagcagttgcactctgtatttatcccagataaatgaaaacttaccttccaataaaaacctgtgcacaaatgttcatagcagcttaatattgaaaaactggatgttcttcagcaggtgaatgaactggttcattcataccatggaataccattcagcaataaaaaggaacaaactgttgatacatttaaccacctggatgaatatcaagggaattatgctgtcagacaaaaaccagtccctaaagactacatatagtatgattccgtttggataatattcttgaaatagagaaattaagagaaatgaaaagattagtgtttgccagatgttagagacagggaggtgagaggggtaagtgggtgtagttataaaagtgcaacatgagggatctttgtgatgttgaagttgtatcttggcagtggatgcagaaatctcaatgtgataaaattacaaagaactaaaaacaagaatgagtatagataaaactggggaaatctgaacaagttagagtgttgtatcactgtcagtatcttagagtgatattgtactatagctttgcaagatgttaccatgggagaaactaaagtgtacaagggatctctaggtattattatttttttagagatggggtttcactatgttccccaggccggtcttgaactcctgggctctagtgatccgcctgccccagcctcctaaagtactggaattacaggcgtgagcgaccatgcctggccctttcagtattgtatcttagaacttcatgtgaatctagcattatctcatagaatttaattaaaagaaattgtaaacctcacagaagatcagaatttcctcaagtttgtgatgttgacaaagatgaactagttgacactgacagtaagactgaggatgaagacacgacgtgcttcaaaaaaatgatttgaatatcaatggattaagaagaactcttttgacaaattgatgaaaccctcagtcagttttataagaatgcccatctttatgatcatgctatgaaagccaatttttaaaaaaattttttgtctttcctaacaattagcttgtggttataatttaaatttagttaaatataagataaatgattttttattaagtttagtttcatttttcaaggtacgatctcaaagctactctttaacctactatgaatgaataatgctgagttcataacatctttgtagatatatccacaattttccctcaggataagtgcctacaagtggaattactggactgaaaataatgcagtttgctaagactttgctatctgttcctgaatgctcctccaaaaaggttttgccagtttacatcctcatgaccagcgaatgagagtgttgcctattttcctgtgcccttgttactgcttaataatttttgaaaaaaatctaatttgacagacaaaaatgcattttatgttaatttgcttttctgggatttttaatgaggttgagtatagtttttaatatttttattggcccctttggaactagtatcataagttttttttcttaagaatttatgtagtctgggctgggcgcagtggctcacgcctgcaatcccagcactttgggaggccgaggtgggtggattgccgaaggtcaggagtttgagaccatcctgaccaacatggtgaaaccgaatctctactaaaagtacaaaaactagctcagcgtggtggcgggtgcctgtaatcccagctacttaggaggctgagtcaagagaatcgcttgaacccgggaggtggaggttggttgcattgagccgagatcgcgccattgctctccagcctaggcaacaagagtgaaaagtctcaaaaaaaaaaaaaaaaaaaaaaaaaagaatttacatggtctgaattgccattaaaagagatatgagaattattgagtaacaaataactttttaataatttaggcaagttttggacgattgtactttgtttagaaaccaaaagcatagtatttgtagtttttttatttactttagttgctaggaagtaaactttattcaaggtctctggtaccagttgttgctaaaagtgattgactaatctgtcaatctgaaattatttgttgctgaactgctaattcttttgcttctatcttttaggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtgagtatgtgattttcttgtgtgtacatatgtgtctcactttctttttttaatttactaagcagaacttcagatgaggaataaaatgattggaatattttttttctcctctaactacttgtaaatttgggagaatttggagagtgtagtagagtcagatcagtgtatggaaaaggagcaggagtgactggaccttctaagaagtgtgttatcagaattagtaaatgaagggtcaaatgtcctacttttcccctccactgattttgacatcaaaccattatccacatagccttatttcctccctcggtcttaattttattaatattttactgcactttgcagataaaatttttaaaaaatttttaaaaattgccaataagtgacatttattaagttcagtgcttagtgtatatttggattttatttattagtcacaagacctttgtgcaggtagtaggcatgattatctttttttttttgagatggagtcttgctctgtcgcccaggctggagtgcaatggcgcggtctcggctcactgcaacctccgggttcatgccattctcctgcctcagcctcccaaatagctgggactacaggcgcctgccaccacacccggctaatttttttgtatttttagtagagacggggtttcaccatgttcgccaggatggtctcgatctcctgactttgtgatccgcctgcctcggcctcccaaagtgctgggattacaggcatgagccaccgcgcccggactgattatcttatttacacatgagaaaaccagggcttagaaaggttaggtaacttcctctaggttgtacagtaaatgtggacctagaagcattttgacaagagcacctgtttttttttcttctctattagtttagaaattatatactcttaattatcacctgggattttgattagacagccttcatgttctttttcatcttaaatgttctttgtgtcttaaagggctaagtgatttcttcagatcttttagttcactcattctcagtgaactaaaatgaggtctaatctgctactgaatcaagttttcagcatgttatttccttcctccctccctccctccttccttccctcaaccaggctcccgaggagctgggattacaggcgcccgccaccactcctggctaatttttatattttagtagagacggggtttcaccatgttggtcaggctgatcttgaactcctgacctcaagtgacccacctgcctcggcctcccaaagtgctgggattacaggcatgaatcaccacacctgacggcatgttattttcatcgcaaagttactgtaagctgggagaagtggcacacacttgtactcccagctactcaggaagcttaaggtgagaagattgcttgagcccaggagttttgagaccaacctgggcaacacagcaagaccccagctcaaacaaagaaaaaaagttattgaattttttatttctatggatcattttttgtagtttcttattcctttcacccttcattcccacttttgatcccatcttttatttatttagttttattaaatgtatatttgtctgataattctgctatctacagttttttgtggacctgactcagcatttctttgtttcttcggattcagactgttggtggcttgtgattttagtgatttttggccgtgaacatgtttcttggacttttgtctgtgggaattctctgtgtactctgtataaattaagttacttcaggtgttttgcattttcttttgccatgcacctggggcctgggtcactacccttctggtaccacttaaaactgaatttttgtcttgggtgctcgtactgatcctgtatgagtacaggtttatacttactgtagaaatatggtgtttgattatggggtattgtcccagatggtgctggagtattaatatgctctctgttaaacttaatgtgttgtccctgtaaaactccaaaattctgaattccagaatactactggccccaaatgtttaagataagggcactgcctgtatttgtttctgcctcccactattttccttagtttaacacaaactcacctttttaaaaaacattttgagagaattcagtattgggaagagtttctaacctgtttctggaaatggaagtccaaagtctgtttctgtaattgttttttttttgagatggagtctcactctgtcacccaggctggagtgcaatgacgtactctcagctcactgcaacctccacctcccgggttcaagcgattctcttgcctcagccccctgagtagctgggattacaggtgcccaccaccatgcctggctgatttttgtatttttagaagagatggggtttcgccatgttggccaggctggtcttgaactcctgactttgtgatctgcccacctcagcctcccaaagtgctaggattatgtttctgtaattgtaatacatttattgtttttagaaactgtctttgctttagtggtaattttcaataaaaatagaaatagcagtggagttattaaaagagcattagttacatttttccctttttcattatcttcaaatattatatatagtaagtttgacctttttaaaatgtatacttgtatcagttttaacacatacatagattcctgtaactgtcaccactataagggtaaagaacagttagttccttcacctttgaagtcaagccccacctctatcccaacacttggcaaccgctgatctttctccgtctcaatagctttgccttttctctttttttttcttatttttttttttgagacagcgtcttgctctgtcgcccgagctggagtgcagtgaggcaatctcggctcactgcaacctccgcctcctgggttcaagcagttctcctgccttagcctccctagtagctgggattataggcacgcaccaccacacccggctgatttttttgtatttttagtagaaatggggtttcaccatgttggccaggctggtctcaaactcttgacctcaagtgatccacctgcctcggcctcccaaagtgctgggattacaggcgtgagccactgtgcccaatcaggactttttttttttaaatttacattcaacttgtcatttttttcttgtatggattgtgccttcagagtcacacctaagagccctttgcctaagcaaaggtcatgaagattttctcatatgtttccttttaaaagtattgtggttggccaggtgccatggcttatgcctgtaatctcagcactttgagaagctgaggtgggcagattacgaggtcaggagatcgagaccatcctggctaatgcggtgaaaccccatctctactaaaaatacaaaaaaaaaaaaaaattagccgggcgtggtggcgggcacctgtagtcccagctacttgagaggttgaggcaggagaatagtgtgaacccgggaggtggagcttgcagtgagccgagatcgcgccactgcactccagcctgggcaacacagtgagactccatctcaaaaaaaaaaaaaaagtattatggttttacactttacgtttagatatatatcttttttgagttaatgtcgtataagtatgagggttacgtcagattttttgttttttgtttatttttacatatggatgtctagttgttctaataccatttgttgaaaagacaacctttactccattgaattgcctttgtacttttgccatatttgtctaggcctgtttttggactcctttttctgtttcatgatgtgtgtgtctattcctttgttaataccacatggtcttaattactgtatagtaagtcttaaaattgggtaatgctggccttataaaacgaattgggaagtttttatttttactcttatttccattttctagaagagattgtgtagaattggtgtcatttcttctttagatatttggttgaattgggaagtgatgccatctgggcctagggttttgttttttgtgtgtgagacagagtctcacttctgtcacccaggttggagtgcagtggtgagatcttggcttactgcaacctctgcctcccaggttcaagttatcctcctgcctcagcctcccaaatagctgggattacaagcgtgtgccaccatgcccgactaatttttgtatttttaatgcagacagggtttcaccatgttagccaagctggtctcgaacttgtgacctcaagtgattagcccaccttggcctcccaaagtgttaggattatagatgtgagccaccgtgcctggcaggggcctagggttttctttttcagagtattttaaactatgaattcagattatttaatagatataggactatttaagttatctgtttcttcttgagtgaatttttactgtagtttatggcctttgagtaattaattgtattgaattgtcaaatttatgagcgtgtaattatttatagcatttcgggtttgtagtggtatccctcttttattcctggtgttggcaattgtgtcttgtttttctttgtcagattgtatagggatttattagtcttttcaaagaactagcttttgttttgatttttctgttgttttgttttcaattttattgattttctgctctttattatttcttttctattatttctgcttgctttgggtttattttactcttttttttttctccaagttgcttaaagtagaaacttagatttctggtttgagacctttcttttctaagataagcatttaatactgtaaatttccttctaaccactgctttagttacacccccacaaattctggtattttgaactgagcacaaatgaaatgttctaatttcccttgaatcttattcttttaccaatgaattatttagaaatatgttatttagtttgcaagcaattggagacttttttcctgttatttttctaccatttatttctcatttcattatattatggtcagagaatatattttgaatgatttcatttattaatttttaaaaataacattaaaaaattttttaaaatgtgaatataccacatacagtataaagattgtacattctgtttttggacagttttctataaatgtcaagttgatttagttggttaatgatggtgttcagtttttctttattcttgctgatactttgtatgcagttatatcactttattactcagaagagtgttgaactttccaactacaatttttttttccaattttactttcagctctatctggttttgcttcatgtattttgaggctctgttgttaggtgtgtacacattcaggatgatatcttctgggtgaattgcctgttttatcattatgtaattccctctttatggtaattttccttgttctaagatcagaaatatctgttgtccaatttatatagacactgcagctttcatttgattagtgcttgcatggcatatctttttccatttttttacttttgatctacctttataattctatttaaagggggcttcttgtaggcagcatatagttgggtagtgttatttatttatttatttatttatttatttatttatttattgagacagagttttgctcttgttgcccaagctggagtgcagtggtgcaatcctggcttaccacaacctccacctcctgggttgcagtgattctcctgcctcagcctcccaagtagctgggattacaggcacgcgcaccatgcctggctgattttttgtatttttagtagaaacggattttcaccatgttagccaggctcgtcttgaactcctgacctcaggtgatccacctgctttggcctcccaaagtgctgggattacaggcgtgagccactgcacccggctgagtcatgttatttttaatcttttctcacaatacagggtttttgttggtaaatttaattattttaatataaattttagtataattatttacattaaatgtaactgttgcactggggtatttataatgtgtaaatataattattggtattaatataattatattactcataataatattaatatctttggatttagattaccagtttagtatatgtttttctgtttctccctctttgatttccccttttttgctttttttttttttttaattcttatttttttttagtatttgttgatcattcttgggtgtttcttggagagggggatttggcagggtcataggacaatagttgagggaaggtcagcagataaacatgtgaacaaggtctctggttttcctagacagaggaccctgcggccttctgcagtgtttgtgtccctgggtacttgagattagggagtggtgatgactcttaacgagcatgctgccttcaagcatctgtttaacaaagcacatcttgcaccacccttaatccatttaaccctgagtggtaatagcacatgtttcagagagcagggggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaactgccatcgtcatcatggcccgttctcaatgagctgttgggtacacctcccagacggggtggcagctgggcagaggggctcctcacttcccagatggggcagccgggcagaggcgccccccacctcccagacggggcagtggccgggcggaggcgccccccacctccctcccggatggggcggctggccgggcgggggctgaccccccacctccctcccggacggggcggctggccgggcgggggctgaccccccacctccctcccagatggggcggctggccgggcgggggctgccccccacctccctcccggacggggcggctgccgggctgaggggctcctcacttcgcagaccgggcggctgccgggcggaggggctcctcacttctcagacggggcggccgggcagagacgctcctcacctcccagatggggtggcggtcgggcagagacactcctcagttcccagacggggtcgcggccgggcagaggcgctcctcccatcccagacggggcggcggggcagaggtggtccccacatctcagacgatgggctgccgggcagagacactcctcacttcctagacgggatggcagccgggaagaggtgctcctcacttcccagacggggcggccggtcagaggggctcctcacatcccagacgatgggcggctaggcagagacgctcctcacttcccggacggggtggcggccgggcagaggctgcaatctcggcactttgggaggccaaggcaggcggctgggaagtggaggttgtagggagctgagatcacgccactgcactccagcctgggcaacattgagcattgagtgagcgagactccgtctgcaatcctggcacctcgggaggccgaggcaggcagatcactcgcggtcaggagctggagaccagcccggccaacacagcgaaaccccgtctccaccaaaaaatgcaaaaaccagtcaggtgtggcggcgtgcgcctgcaatcccaggcactctgcaggctgaggcaggagaatcaggcagggaggttgcagtgagccgagatggcggcagtacagtccagcctcggctttcacaactttggtggcatcagagggagaccggggagagggagagggagacgagggagagccccttttttgctttcttttggattatttgaatttttccttaaatttatttatcttacttatttatttatttttttgagtgattctcctgccacagctcccaagtagctgggactgcaggcatgtgccactacacccagctaatttttttgtatttttagtagagacagggtttcaccatattggccaggctggtcttgaactcttgacctcaagtgatccacctgcctcggcctcccaaagtgctgggattacaggcgtgagccaccatgccctgcctttttctagaatttatatattgagttcttgattgtatctttttatgtaggctttttagtggcttctctaggaattacaatatacatacttttcacagtgtactcacatttaatattttgtaacttcaagtggaatgtagaaaacttaaccaccataaaaatagaactagggatgaggttaaaaaagagagagaaaagaaatgtaataaagatttaataacaccgtttttttttttttttctcttttttttttgagacagagtctctctttctgttaccaggctggagtgcagtggcgtgatcttggctcactgcaacctccgcctcctgggttcaagtgtttctcctgcctcagcctactgagtagctgggattacaggtgcgcgccaccatgcccagctaatttttgtatttttagtagagacggtttcactgtgttggccaggatggtctcgatttcttgaccttgtgattcgctctcctcagcctcccaaagtgctgggattacaggcgtgagccaccgcgcccggctaagtctttaaatatttttttgacattgcactttttctcttttccttctaggattttagtaacccaaatgttagttttgttattgtttggcaggttcctgaggctttccttacttctttaaatttttttttcctgttgttcagcttcgaaaatttctattcatctgtcttcaaattcactggttctttcccgttatttccattctgttattgagtctttgtagtgaattttaaattttgtttattatgttttttagttctaaaattttctttttttgtgtatgtcttatactttgctcctgaaactcttatttgtttcaggagtgatcttatttcttagagcatggttttagtagctacttaaaatttgttttatcatcccagcatatgtgtcctcttgattgtcttttctcttgtgagataatgggattttctggttctttatatgacaattaattttggattgtatcttggacagtttgacttacgttacatgattctgaatcttgtttaaatcctgtggaaaatattgaagtttttgctttaacaagcagttgacctagttaggttcagtccacaaattctaagcagcattctgtcggctctggttccatcatcagttcagttttgtatcttatctgcttatgtgcctttctgtgtccagtctgggacctggccaatggtcaggtcccaaagcctttgtacacttttagaagcagggccatgcacacccagctcacgagtggccccgggagtgcacatacaactcgacgttttcatgggctccttcttttctgtgatgtccctgacacgttctgccttctaagaacctccctttatccctttcctgttgtctggctagaaagtcagggctttagattccctatacttcagcacacttcctgtagctatgtcaacctctgtggccacgacttcttcttcttgggactgcagtttctcttgtcagaaagtaggattcttggagctgctgtcattgctgctgtggctgctctgatgctgcctgggagtcgaaggagagaaaggaacaaaacaaaacaacccaggggatttcctccactctctttgatccgtgagagccccctttcctgttcctcagaccagaaatagagggcctgtcttggaacttcttctttgtgcatctggtgtgcagtttcagcttttgagtccaggccaggaggtgctggacaaacttgtcaggagtacggaggtactgcaagttctgattacttttctcagtccacctgcttccaagtccttggatgcatttgtccattgttttgagttgcattccatgggagagacagaagagtgtgcttatttcatcttgacatacttattaggatttcatatcaaatcaacggatgatattctctatattaatttgctgttttccctttagcaagcacattaggaaaataacactttaacacccgcctttggtggtttctgtcataattattaatacttgactttttttttttttttgagacggagtctcactctgtcctttgaggcattgtccccataaacttttggtaaagcatcaataattttatctttcatccacacaagcttcaccataaatttgatgtttattcttccattttagcagaattcatgttgctccaataggggctgtcttcaaactgatgttttctccttcttagtgcctcagagtagatcctgttcagatacgttataacaggttaatatgagtttattttggtgtaaaagtactttgaaattcatgcatagttttttcatcatatgcattttccatagctttgaacacccccatgtaactctcctcttccacaaaccaaacaatgaaaaagcacctttgtgatggaagtttattttgcaataggaactcacagtgatctaagccctgctattcatgaatataattcattactggagtccaagttgctttttggtttttgaagttctcttcttcccttgcaggtatagaacaagatgcagtgaatacttttaccaaatatatatctccagatgctgctaaaccaataccaattacagaagcaatgagaaatgacatcataggtaagcagtgcttgaaactatggcaaaaaaaaaatgacaaaaaatgcacagaactgacaattttcgttattgactaagataattttttcttaacatggaatttagcagttcccttcctaatttgttttctgagtattttttatatcggattatagctcactttaaaagtttctcggctgcattcggtgcgagggtctttgcctgggccagatgggctgcagtgtagcgggtgctcaggcctgcccgctgctgagcagccgggccggcgggcggctacgctaaccggcacagaccaccggatggactggccggcagccccgcaccagtgcacgaagtgggcgggacagaaacttctggggttggaagtccagtgaggctaaaagccggtaccaaagtctctaggcatcagggctgcagcccaagagtctcacgaccagtgggcaactggatggccagacaggtgtctcagtggtggcctctccgtctcagggcttcatcccacttctcagtgggcctgacgtccctgggcaccctggatgtctacctgcattagccagagccatcacatggcctgtgacttgcctttttttgccagttgattgtgccacacacagtgtcatttctgtgtcatttggcacagctggaggtgcaaggaggagggcagcctcatgtccagtcccagtttcacgtaactttattcttctgaataaagacaatttgctaaccttaaaaaaaaaaaaaaaaaaaaagtttttcttatatgttggacccaaattcttaggctttaacctgaataacaatgacagcaagatcaataaatagtacacatttattaaacactcactgtgtcccagacaatattccaagcactttttatggatagactcattttaacttctaaagaactttgtgggataaatacagttattttatagatgaagaaactgaagcacagagaagttaagtgctttgtccagggtaacagctcagatatggcagagtcaggatttgaaactagaccctcacataccttaactgctgtgctgtggcagtgtttttcatactgtaggttgggaccagccttctcttatgccctcaccccctgccaaaaaaaaaaaaaaaaaaaaaaaatatatatatatatatatatatatatatatatatatataatatatatatatataaaatatatatatatataaaatatatgtattagtatatatgcatatatagtatatattatatattagtatatatactaatatataatatacatattagtgtgtgtatatatatatatactagaataaaaaaatcaaagtatctcagagtagtaaggacaaacatttcagaaaaatgttttcattatatatacatgtatgtatgtgtatgctgattcaacaaatatatttcttataggttatagcaaaatagtttgaaagcttttactgtgttttatcaggaagaccttaggtgaacgtatattcacagataaaagaggttatttattcattcaataaatattacattctcataagtcctaatattatgtatttttattcttcaaaaaagttagtatttgtgatttatgaaataagacatgttcttgcacttttagcagatctgtcccgatgttgggcttctttaatccttagtgtgggtgctttgcactcactcactgctggggacagcaagacccctgttagtctcagctgtgtttcttaaattggcccactgtaccttccagttagctattctggggtccatgtcatgttggctccattttccttttctttctcccacacagatacctataacggctataacataggcctggtggctgttggtggcttatccctatctgcttgtatttaaggggtactgtttcactgagttttgctgacagatgttgtcatgagatttgaggttttctgtgttgttgctctatttttatgtgggaatttgctactatcatcatccctagaccagcttttcctagtaatacaacagggatgttctgactgattagagtttgcctgtttgaagaattggttggctagtgatttttttttgaggggagtctgtaccagttaatagcctgactggcgtgtggataaaaaggaagcagtttcaagtcaaataaaacacttaaaatgaaaccacactgcaactctctttcttttacttaagcttaatcaaattaatgatgatgtaatcccatgaaggaaaagtcttctgaaggatcaagttgataacattttgtgatcaaagaatttgagaaaacctctatcccagtgtctatcattatatattttaggatgttaattacctgtgtggctttaggcaagtcatttttcctccttgagccccattcttaatcctgtccaaattatttgtctcctcttgcagttggactattttaatatagctgtccttcaagtgagttttgttcaaaggagccttcactttagctcttactgtgtacccactttgcatagtcttgttttaaatgtaatccttggatttttggtgttgctaactaattactgtttttatgtgaggatttagagtgatccagaatctatacttgcactacctccttcatcttccacaaatgtttgaagtggtagaatttttaaaaactttgaaggtacagctgacagaatttgctgatggtttggaagtgagtggtatgagagggaaaaaaaggaataaagcatgactgcattttttgtttgtttgtttgtttgtttttgagacggagtctcactctcgccaggctggagtgcagtggcgtgatcttggctcacggcaacctccgcctcctgggttcaagcgattcccctgcctcagcctcccaagtagctgggactacaggcgctcgccaccacgcctggctaatttttttttttgtattttagtagaaacggggtttcaccgtgttggccaggatggtctccatctcctgacctcatgatctactcaccttggcctcccaaagtgctgaggttacaggcatatatataagcatataaagtgtgttatagcatacaaacaggtatatatataaacatgcagtccacacagctgataggaatgaggcagtagtgaaggagaagttgatgtaggagaggggacagttgttacaggaaagaagtctggaggcagaagggatgaattccagtgctcacatagaagattgcttagatgggagcaaggacaatttatctagagtcacaggaaagaatgcagtacacgggtagagatgcaggtgagttgaaagatgtgagagatgatggaaataattttctgattgcttctatattctcaaggaagcaggaagcaaagtcctcagcaaagagaatagaagaggtgttaaatatttgagaaaggagatgtactgtagaaaaaaaaaaaactcagtttctccttctgaactctcacaaaacagaacccttccatgactctagttgtgtggggttttttccctgtcagctaccaattctgcagatgattgttcagtgaacaccaactgggtgtcctctaagtcagttcagttctcacactgtttacctggagatagcatcagatcccacagattgaggactctgtcccacaagactgcctccacttcagatgccagtctcaagtacaagttgtggcctgtgcttctgactgaccttctataaattggagttcccacagtcccctccttgggttcaataaatttgctagagcagctctcagaactcagggaaatgctttacatatatttacccatttattataaaggatattacaaaggatacagattgaacaggcagatggaagagatgcatgggcaaggtatgggagaggggcacagagcttccatgcactctccaggtcatgccaccctccaagaacctctacagatttagctattcagaagcccccctccccattctgtccttttgggttttttgtggagacttcattatataggcatgattgatcattggctattggtgatcagctcaaccttcagccccctcatcccgggaggttggtgggtagggctgaaagtcccaaacgtgtaattctgccttggtctttctggtgattagccctcatcctaaagctctttagaggccacagccacaagtcatctcattagccttcaaaagaatccagagattccatgaattttaggcgctgtatgctaagaaactggctaaaggccagttgcaatgtctcaggcctgtaatcccagcactttgggaggctgaggcaggaggatcgtttcaggccatgagatcaaaaccagcctggtcaacatagtgagacccccttacaaaaaatttaaaaattggccaggcgtaatagctcttgtctgtagtctcagctactcagaaggctgaggatcactgagccctggagttgaaggcagcagtgagccatgatcgtgccactgactccggcttgggtgacaaagtgagaccttgtctcagaagaaaaaggaaaaaaaaaaaactgggcaaagactaaataacatatttcacagtatcacagatttgtattgtctaggaaagtgaatgtaaacagaccaggacactagtatgatcccttggtttcatgaaggtcccactaaagtcatgaacacaaagtgagactaggcatcatgttatatggtttttccagccatgtttaacagctagctaaatagctaattgtttcgctgcagtttattttagcagttccttattttagcacatttcatgttttaaaatttctaccaataacattttaataaacttttttacagataacttcacaaatccataattttttaagttacaatcccagaaatagaattgctcattgaaagggtatgttcatttttaaagttatgctagaaactgccaaattgccttcagaaaaaggtgtttgtatccccactaacactagtgttagttttcttgtgcccttgctcaagtatacatattattaaaaacaatgttgggccagtttactagataaaaggtgtagtgcctccttattctaatctatttgattactagtgagtatgtatgtcttttcacgttggtcattttatgtttgttcctttgtggattgtcatgtcctttgctcatttttcttttggaacatttcttagtagtttataagagctcttggtattttaatgatagtaaccttttaactgtcatgcatgctgcaaatcttttttctgtttgtttgcctttgtattttgtttttggagggtttctatgtataggaattaaattttatgttgttaaatcttttgatttctgcttttgcatatgtacttcaaaagactttctattttaagatcaagtgttacctgtattttcttttagttctatttaaaacctcttaatttatatgcctgtgctgttaactcccaagttgattcacaagtgtgtatacatagtttgaatttagtggcaatttaattatttacaacttcttttgcagcaaggatttgtggagaagatggacaggtggatcccaactgtttcgttttggcacagtccatagtctttagtgcaatggagcaagagtaagttagttcatattttcacattgtgcatcctagggaatttgggttcattgttaggaatgggcttcactcagctaaaaacaaagtatttttgagaatttaaatattttggatatttacaagatcatataaagcatactctatcttggttaacagtttcttttaaatataaattatgtgaactcttaaaattttcattttcattttcaatgttaatatttcctaagttaaaataatttgtttttagttctgaaataatttggggagtgattgagtctgtagtgattatgactattagaattggtttatttatttaaataatgcatgtcttcagatggctctcctaatttgttagttaggctttaagctaaatggatgctatataactaaatccacatagatttgttgaaatggctccagaggttttttagatttattactgctatgtgcccttaaaaaaaatctattcattctttcacttaacatttatcagaagagtgctctgtgtaagacgtggttaggcatagtgccagtcttgaaggaagttacagcctaataaaagacatagggcatgttgtttggttactgtaatatgaagtggcatgtgttaaatgtcaggggagaactacaaagtcataaaaaggtgggagagattacatacaggtaaaggaatcaggaatgacaccatggggagtaaggtagtgttgacctaggcctttaagatacaatagggacagtatggaaagagtatatttttcccacttaaactctttccttggtcgttccctcaaattttcccttttgtccatgtgcaggcactttagtgagtttctgcgaagtcaccatttctgtaaataccagattgaagtgctgaccagtggaactgtttacctggctgacattctcttctgtgagtcagccctcttttatttctctgaggtaaagtctgcatttcttttcacactctattcgagcattccagcctctaactatcaatgctggggccctgtctataggaaataacacagaagagccaagtcatttccaaaaagatgtatcattgtttcaagttgtttctgatggcaagagtaatttaataatatattagagagaacatgaaaattcaatgtattaaataactctaattttgagaaacctaattaaactactgcatgtaagagagtgcatgtttttaattatttggagctattttaaaaccacagaatttgaaacttgcttccagtgcataaattgcagaccagacttcagaagagaaaaaaagtagtaaattttttcttatgctcatcatttttactttagtcacttgataggattgcccagtgaagaagcatttgcaacagacaatgagtatattaatctttttgaggcatacagtttagtataatgctctttgttaggcttcaacaagtgaaattattttgttggaaagcaaatgactattaagtagaaagaggattcccagtctcacaaagcagtaatttagacactcgattctgcctctttacaagaatacaggtactcagttgatttgttttctcactccctttctttgctataagtttaaatcaacaatttgtttaggttaatatgtcctcatggaatggtggaaatgatcagatataaaatatttggtttggttagtttactctttatatgtttgctggcaaggaaccacaaatccagtttagtataatttttactctagttcactaaaagtttgcatccagctgtgtaggtagtgtttgtttcttgttaacttttttttcgtctaaaagaatactttaaaacttttcaatctcaaatgactgtaacttgctgacaggtgttaacagaagaagtagatctttttgttttttgcttatgacctgtattttaatatttgagcttatagattagagattgtgagagaaatctgtttatagtcttattttcccttgtgtattttttcttcctagtacatggaaaaagaggatgcagtgaatatcttacaattctggttggcagcagataacttccagtctcagcttgctgccaaaaagggccaatatgatggacaggaggcacagaatgatgccatgattttatatgacaagtgagttatattgatagatggattcagcagatacttattgaacatttgatatgttttgtggaaataaagatgaataaactcagtctctgttgtcaaggagctcacaggaggcagcataaaagctgcttttatatggtgtttgtaaagctttgggggttcttagaacaaaagtttctgctgggaaaggggaggtgtatgtggggtaaacaggatggcaatggtggtgttcaaggagtgtttcccagaagagagattttgtttggatcccaaagaaagaagggaattttgctacccagagaaggcagaaaacaacattctaggcaaaggcattggcccagaagccatggaaacgtaggggaaagtggcactttcaagaaacttgagtttagataatcaaaggagtggggaataaatatgaggatgctggtactaattggaatagattgtaagggaccttgaatgcctatttatgggtatattatactttctgtataaatctgctcaggcacgttgttaattagttttttattagttttcactgaaaatgagaggatggaaacatcatacagtaaacaaaattgaaaatatctggtcaggcagatgatgagcttgtggccagctctgtaacgtatggtattcttttcatttaacttttcttactctgtaaaaaaagtaattcgtggtcgggcacggtggctcactcctgtaatcacaacactttgagaggcagaggcaggtgaatcgcttgagcccaggaatttgagaccagcctgggcaacatggcaaaacccgcctttactaaaaatacaaaaattagctgagcgtgatggcgtgcgcctgttgtcctagctacttaggggcctgaggcagaaggatcacctgagccttgggaggtcgaggctgcagtgagctgtgatccactgtactccaccctgggcagggcagtagagtgagaccctgtctccaaaaaaaaaaaaaacaacaaaggtaatttgttatttgtatccttaagcaaatgctaaaggggtaacttggggatagagaaaagtccacagatgttagggtttgaagacactaatagtatctaggccagtggttcctgaacattagtctgtgggctcttgctgggctgtctgcataggaatcacctgagagcttattaaaaataggttttcaggctggttgcggtggctcacgcctataatcccagcactttgggaggctgaggcaggcggattacttgaggtcaggcgttcaagaccagcctggccaacatggtaaaaccccgtctctactaaaaatacaagaattagccaggcatgatggcacacacctgtaatcccagctactcaggaggctgaggaaggagaattgctcgagcccgggaggtggaggttgcagtgagcggagatcatgccactgcactccaggctggctgacagagggagactctgtctcagaaaaaaaaaaaaaaataggttttcagtctgggtaccggtggctcacacctgtaatcccagcactttgggaggccaaggcaggcagatcacttgaggtcaggagtttgagaactgcctggccaacatagtgaaaccttgtctctactagaaactacaaaaaattaactgggcattttgacgggtgcctataatcccagctactagggaggctgaggcaggagaattgcttgaacccgggaggcagaggactgcatctcaaaaaaaaaaaaaaaaaaaaggtttccagtccccctgtctcagaaattctgattctgcaggtttgaggtgtgaccaggaatctttatttttagaagacataccagataattctgataaatagccagtttagggatgtagtctaattttcctattttgcaagtaaggaaaataaggcccagagaggtaatgattttctcaaagtcacagaacaagttagtggcagaatttggactggaatgcagttcttaatgttctgtccagtgtttattctggtacagtatgtttgtagaaggtattacgtaagaaacattgttatatagatgttgagataggaagagtttacatttagaaatttggtctaaaatgcctgaacattcaagtcgtggaggagtattgaccaacttactcaatacaacataggagattcacattttgttacaaaaatgctgatttaaaaggagagttttcttttttttcttcttttttattttttgagatggagtcttgctctgtcacccaggctagagtgcagtgacacgatctcagctcactgcaacctccacctcctgggttcaagcggttctcctgcctcagcctcctgagtagctgggattacaggtgggggccaccacgcccagctaatttttgtatttttagtagagacagggtttcaccatgttggccaggccggtcttgaactcctgacctcaagtgatccacccaccactgcctcccaaagtgctgggattataggcgtgagccactgtgcccagcctgcttgtttttgtatcatatatatgcatcatcataatcatgcattatcaacctttgtatttctgtcaggacatagaaaccattagagtgcttggaagagagcctttttttttttctcgcatttaatgctttttttggtattcatttcataatcagcttaccaaaacattacctgcattataccccatcaaggtagaaatctttgtgttatcaatattggttactccctttccacaccgagtcatcagtaagtcctgttctatccaaataggtcatatgcatctagctcacccctcagtgctgttttgttttgaatttgtacatgtttactcctgatgccttgtagttatgatgatgtgttcttattttattctgtgcatacaagttctcagctcgctttttagggaaaatgaccatgtcttcctttcctataaattcctttctatctatcaagtcctcaacagagaataggtacccataaatatgtgattgttagtttctttgcctcagttgtagtctgatccttacagcttttaaacaacagtagagttcaccgtcaagaactaaggatggttggcaggcagatagaaaggtagcaagttgacccaactatctctggggaagtgggaacaaagaaaggttacatcagcactgtcatcacatagctctatagttctaggcctgcaggctcaatcaagtagccttgtataagattctctggaggaggtgctgaaagttgcttatacttgctatggaatttgattttacttcggatatctttttaccataggtacttctccctccaagccacacatcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagtaaaaaagaaaaaagaaaaactaaaaagataaaagaataaccaagaacaaaacaaaaaaaattataatggagctgaaaaatctctgttgcctcatatttactgtactatacttttaatcattattttagagtgctccttctacttactaagaaaacagttaactgtaaaacagcttcagacaggtccttcaggaggtttccagaaggaggcattgttatcaaaggagatgacggctccatgcgtgttactgcccctgaagaccttccagtgggacaagatgtggaggtgaaagaaagtgttattgatgatcctgaccctgtgtaggcttaggctaatgtgggtgtttgtcttagtttttaacaaacaaatttaaaaagaaaaaaaaaattaaaaatagaaaaaagcttataaaataaggatataatgaaaatatttttgtacagctgtatatgtttgtgttttaagctgttatgacaacagagtcaaaaagctaaaaaaagtaaaacagttaaaaagttacagtaagctaatttattattaaagaaaaaaattttaaataaatttagtgtagcctaagtgtacagtgtaagtctacagtagtgtacaataatgtgctaggccttcacattcacttaccactcactcgctgactcacccagagcaacttccagtcttgcaagctccattcatggtaagtgccctatacagatgtaccattttttatcttttatactgtatttttactgtgccttttctgtatttgtgtttaaatacacaaattcttaccattgcaatagtggcctacgatattcattatagtaacatgtgatacaggtttgtagcccaaaagcaataggttgtaccatatagccaaggggtgtagtaggccataccatctaggtttgtataagtacactctgtgatgttagcacaatggcaagcagcctaacggaaattctgtttattgattgattgattgattgattgattgagacagagtttcactccattgtccaggctggagtgcagttgcacagtcttggcacactgcaacttctgcctcccaggttcaaccaattatcctgcctcatcctcccaagtagctgggattacaggcaggcaccaccatacctggctaatttttgtattttagtagagacagggtttcaccattttggccaggctgttctcgaactcctgaccttaagtgatctgcctgctttggcctccgaaagtgctgggattacaggcatgagctaccatgcctgggcagtaactgaaattctctaatgccattttccttatctgtaaagtgacgataatatgcacgtttacctcaaagttactttgatgattaaagtaaggtaatgtatataaaatacatattaacatagtacctgacacatggtaagcatcaaaaaatgttaactacttttattactattattattacgtatttttaaataattagagagcagtatcaaaaattagctgggcgtagtggcatgcacctatagttccagctactcaggaggctgaagctggaggattgcatgagcctgggaattaaaggctgcagtgagccgtgttcatgcccctgcactccagccttggtgacagagcaagaccctgtcttgaacaattaaagaaggcattatgccgcaacgttagcttagaaatgatccacatatatcaccagtaactgtcaacaggattggaaccctagttttgggtattatgatcacaaggtattattaatagcttattaataataaagcgttggctaggcacggcgactcacatctgtaatcccagcactttgggaggccgaggtgggtggatcacctgaggtcaggagtttgagaccagcctgaccaacatggagaaaccccatctctactaaaaatacaaaattagccgggcgtggtggtgcatgcctgtaatcccagctacttaggaggctgaggcaggaaaatctcttgaacccgggaggcagaggttgcagtgagctgagatcgcaccattgcactccagcctgggcaacaagagcaaaactccgtctcaaaaatataattataataaataaataaaagtaaagtattgatgtttgtgaatgatttattcttctaatgaactagaggagatttttccaggaatttcagagccagtgaggttatgttgcttgtatgtgtcatgtgtatccaggtgaaaaaacttaattaaacgctattatataataccatacataaaaactgaattttaggaatactgaagaatgacatatagaagtcaaatcattaaatagctagtagtaaacagaatagagtgtcagctgttacccaatgatgataatattttcacgattaaaattaaaccttttctgattttaaaggaaaagttcagatctgtatcatataaagaatgtaaattttcagggtaataaaattaaaatgcagagagaaaaatgcaaaaatagttcttactagatgtgtgtatgtaaggaacttagactaattttaagaacactgtcaagaccctggtagttaggtaggaaaaaagacatgaatgattcattcaacaaaaactttgagtatttctgtgctagatggtagtgttacagtggtaaacaaaataaatgtgtttctgctatcctggagcttagtctacaaaaaaggtacatattggccgggcacggtggctcacgcctgtaatcctagcactttggaagatcgaggcgggtggatcacctgaggtcaggagttcaagaccagcttggccaacatggcgaaaccccgtctctactaaaaatacaaaaattaactgggtgtggtggcggacacctgtaatcccagctactcgggaggctgaggcaggagaatcacttgaacctgggagacagaggttccagtgagtcgagatcatgccactgcattccagcccgggggacaaaagcgaaaatacgtctcaaaaaaacaaaaacaaacaacaaaggcacgtattaaatacgaacataaatatttacaaattatactgaataagttctcatgtttattatttgcttgtccagttacaaacttttccttcgtagaattagaaatataaataataaacatgagaactcattcagtataattaataattattaaatgtaaataaaaacatctatgtacaattaggcatttatttaagaattatttgaaaaaaaaacaatgtggaaacagatattttgatatattgctagtgattgaaattgataatgttcttttgaagagtaaagtgaccatatatattaaagttaaaatttaactcagcaatcacacgcctggtgagttatcttaaggaaatcagtttgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttttttttttttagacagtcttgctccagcgtccaggctggagtgcagtggtgcaatctcggctcactgcaacctccatctcccaggttcaagcaattctcctgcctcaggcctcccgagtagctgggattacaggcgctcaccaccatgcctagctaatttttatagtttttagtagagatggggtttcatcatgttggccaggctggtcttgaactcctggtctcaagtgatccgtctgcctcggcctcctagagtgctgagattacaggtgtaagccactgcacccagccttatgcattataattttaatttgtaaactgtacaaagggataatacttgtagtacaacaagaagtaaaaacatttgttataggtagttaacatttgtaaccagtagaattataggtaaaatttatttatttaaaacagttttagttggatttgatttcaactttaaaataatgcttttcatctctatcaggtctttttgcctggctttttgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcaggtattgactgattgcgtctgccattagggagaaaagcatacacatcctttccttcacatcccagtaacagatcctattatttgtaaattttaagttgtggaaaaaaaagataaaagccaggcacagtggcctgtgcctgtaatcccagcactttgggaggctgcggtgggcggatcacacgaggtcaggaattcgagaccagcctggccgacatggtgaaaccccatctctactaaaaatacaaaaattagccgggcatggtggcaggcacctgtaatcctagctacttgggaggctgaggcaggagaatcgcttgaacccaggaggcagaggttgcaatgaaccaaaatcacgccactgcactccagcctgggtgacaaagtgagactgtgtctcaaaaaaaaaaaaaaaagagagaaataaaattagcctacttactatcttctaatcaaagcatttgtggtaacttaaaatatactgtattgtaaagtatcatgctgtttcatttaggccattattctatttgaatctgtggctgtttctcttaataaatcaagtaatatggaatatattcatagcctctgaagagctctttatgtaagtatttatttaggatactttttgtaaaataagtgaatgaattcttaggtctcctttttttttcttttcttgagacagggtctcctcgctgcaacctggaaattctgggctcaaataatccacccaccacagcctcctgaatagctgggactagaggcatgcaccaccacgcctggctaatttgaaatttttttttggccaggcatgatggttcacgcctgtaatcccagcactttgggagaccgaggcaggcagatcacgaggtcgggagatggagaccagcctggccaacgtggtgaaaccccgtctctactaaaaatacaaaaattagctggttatggtggctcatgcctgtaatcccagctacttgggaggctgaggcaggagaatggcttcaaccagggagtcggaggttgcagtgagccgagatcacgccactgcactcctgcatggtgacagagtgagactccatctcaaaaaaaattttttttttaaatgatggagtcttgctgtgttgctcaggctggtcttgaacccctgacctcaaatgccgcctgcttcagcctaagtttcttttttttttgtaaagagacagggtcttgctatgttggccagggtagtctcaaactcctggcttcaagcagtcctcccaccttggcctctcaaagtgctgggattacaggcgtgaaccactacctataatgttgtgtttcactcaaggccttttgatttcgttttgcattaccgtgccacattgtgcatttccttgaccttttttgggttttttggagtgctttcatatgttaaaccatacctgattctcctcaaaatcacacaaagtagaatatcctaagacaagaaatctaaggaggcataaagaagttaactggttttattaaactcacacagtaaatgatagagccagaaatattccccttctagtgttcttcaccatcagcttaatgtagcataataattttctaattactgttgacaaataaataaccctttgaattttcaatactgggccttggataaattttcctaatttgtaagagagtattatcgtattgccatttacaaagctctcctgagtatctttttcttctgttaagtttacctaggagataaactgctgagtatggttgccattttggttttttgatataggttagaatgtcttggttttttttttttttttttttggtttttgttgttgtcattgtttgagacagcatcttgctctgtcgcccaggctggagtgcaatggcacgatcgtggctcactgcaacctccacctcccgggttcaagcaattctcctgcctcagcttcctgagtagctgggattacaggcatgtgcaaccacacctggctaatttttgtgtttttagtagagaaggggtttcaccatgttggtcaggctggtattgaactgctgacctcatgatccacctgcctcggcctcccaaagtgctgggattgcaggcatgagccactgcacctggctgaatgtcttgtttttgattaggcacttaagaaaggcctaggtactaaccataaaatatatttttataccttttgttgatactatatatatagaaaactgcacttatcataaccttagacaccttgaagaatgttcacaagcagaactaacccatgtgacccagcatccagatcaaaaacagcattatcagcccctctagaagccctcttgggccccttccattcactgtccttcttgtcaccagggtagctactatcctgacttttgatggcatagattagcattacctgttcttgtcattttataaataaaaccatactgtgtattcttttcttgtacagctttattgtgctaattcacatttacatcatacaattcagtggtttttatatggtcacagagttaggtaaccattaccacatcgattttagaacatttttttcactccagatagaaaccccctttacttaaactccaaatcccccactccaccagccctaggcagccactagtctactttttatctctatagagacaatagatttgcttattctggacatttcataaacatggaaccgtatattatgtggtcttttgttgccaactgtctttcacttagcatcatgtgttcaaaagagcatcatgttatccatgtttggcatgtatcagaattttattcctcattatggccaaatatcccattgcaaggatttatgacattttatttgaattgtaccctcctttctgccatttatcaataatgctactgtgaccatttgtgtacaagtttttgtgtggatacaggttttctttttgtttttaaatttgaggtggagtcttgctctgtcgcccaggctggagtgcagtggcacaatctcggctcactgcaacctctgtctcctgggttcaagcagttctcctgcctcagcctcccgagtatctgggactataggcacgcaccaccacgcccagctaattttttagtagagatggggtttcaccatgttggccagtctggtctcgaactcttgacctcaagtgatccacccatctcggcctcccaaagtgctgggattacaggggtgagccactatgcccggctgtggttttcatttcttttgttgtatatacataggagtagaattgctgagtcaagaggtaactcttaaacttattgaaaaactgccagattgttttccgaaaaggctgcaccattttgcaatcccaccagcagtgtatgagttttacagcttctccacatttcattggaacttattatctgtttggctgtttttaaaaatgatagtcattccaataagttctacttcagtgtggtttttgcacttctctgatgagtaatgatgttgagcatcttttcatttgcttattggcctttgttctagctttggaaaaatgtttattcaaatcctttggccatttttatttttatttttatttatttatttttttttgagaccaagtctcactctgtcagccaggctggagtacaatggtgtggtctcagctcactgcaacctccgcctcctgtgttcaagtgattctcctgcctcagcctcccgagtagctgggattacatttcaggcacctgccagcatgccgggctgatttttgtatttttactagtgacagggtttcaccatgttagccaggctggtcacaaactcctgacctcaggtgatctgcctgcctaggcttcccaaagtgctgggattacaggcgtgagccattgggcccagcctagattttcttttttctttttttttttgagaaggagtcttgctcttgttgcccaggctggagtgcaatggcacaatcttggctcactgcaacctctgcctcctgggttcaagcgattttcctgcctcagcctccccagtagctgggattacaggtgcctaccaccacacccagctaacttttgtattttttttagagacagggtttcaccatgttggccaggctggtctcaactcctgacctcaggtgatccacctgccttggcctcccgaagtgctgggattaccggcatgagctaccaggcccagccaattttctcattatattgcccaggctggtctcaaactcctgggttcaagtgatcctcctgccttggcctcccaaagtgtggggagtacaggcgtgagccaccttgctcagcccctttgcccatttttaaattagattgcctttttatattgagtttcaggagtcctttatatattctagataaatgtcccttatcaaattatattatttccaggtattttcttcattctgtgagttgtctttcctctaccttttaaaaaaggtgggtttttgtttgtttgtttgtttgtttttttaagataaggtctcattctgctgcccaggctggagtgcagtggcacaatcacagctcactgccacctcaacttcctgggccgaagtgatcctcttacttcagcctcctgaatagctagggccatagatacacactatcacacccagctttttttttctgtttgtagagacagatcttactgtgttgcccaagttggtctcaaactctaggctcaaagtgattctcccacctctgcctcccagagtgctgggattacaggtgtgagccacacgcaacctgtcttttcactattaatagtgtcttcctgcttcagcctcccgagtagctgggattacaggcacccaccaccatgcctggctaatttttttgcatttttagtagagacagtgtttcaccatgttcacccggctggtcttgaactcctgacctcaggtgattcacctgccatggcctcccaaagtgctgggattacaggcgtgagccactgcacccggccaaaatattgccttcttaacagtattgtcttctaatttgtgaacatggatgtatcttcatgtatttatgtgttctttcatttcagcagaattttgtagttttcagagtagaagcctttcacctccttgggtcatttattcctatgttttaagttcttttcgattccattataaatagaattgttttcttaatttcattttcagattgtttgatgagagagcatagaaatacaagtgatttttacatgttgatcttgcaacttcaactttgataaatctgattgttagctctaatagttttcttgtggattctttaggattttcaatatataagatcatgtcatttatggatagagatagttttttttctggctagaacttacagagcaatgatgagtagaagtggcagaagcaaaaatctttgtcttgtttcctatctgacagggaaagctttcagtttcatcatttaatatgatgttaggtgtgggttttcaataaatgccttttttcagattcaggaatttccctatcattcctgattttttaaggcttttttttttttttaaatcatgaaagggtgttgaatattgtcatgttctttctgtatcagtataaatgatcctatggattttgggttttattctgttgatgtgaaatattaattgattttcagatgttaaaccaaccttgcatacctgagatgaatctcacttggtcatggtgtataatcttttcaatatgctgctggattccatttactggtattttgttgaagattttgtatctgaacgcttaagataacatttacactctatcagaaatgaattgaccataaatgtgagagtgtatttgtgggttcttgattctcttccattccaaagatagacatacatccgtctgtatgtctgtctttatgccagtaccatactctcttgattactattgctttgtaataagttttgaaatcagaaagtataaatgagattttggtatctgagtaacagtcctcatagaattagttgggaaatattccctctttattctggtccctctttcttttttgtttaactgtgtatcttggagattgttccttctcaacacatgagagccgctttccctaccctcccacccctgctatagagaggtctataagtgtctgttcaattattttatttacttaacctattacttagtcggggacattaagcttgtttatgtcttttattttaaacaatgctgcagtgaataatcttgtatataagtcattttccatcaatataagtctctctgtaactgaatttttagaagtggaatttctaggtcaacctatggctctgtatttcacaaaaataccaattctggtttttcttgtggaggtggggagtaggaggtagaatgctggaggagaacttgctgtactcagctggctagtcattttagaaaggtttccttagcttctttttgtcatatggcctcaccaagaatcaaaaacattcctatttaccctgtaaacatggggctttactacccaagatacatatttctggatgtatgacagcttttcatattgaagaaataatgctgtgagtacagcacatttgttggaacttaggtcgttaagaatgtcttataaattcatacattatacattttattttattttattttttagtttttgatacagagtcttcctctgtcgcccaggccagcgtgcagtggtacaatcttggctcactgcgacctccatctcctgggctcaagtgattctcatgtctcagcctccagagtagctatggttacaggcatgcaccaccatgcccggctaatttttttatttttagtagaaactgggtttcaccatattgaccatgctggcctcgaactcttggcctcaagtgatcggcctgcctcagcctcccaaagtgctgggatccttgtattgggtaaaagatgaatattgagggctgcatggtggctcatacctgtaatcccagcactttctgagactgaggtgggaggagtcctggagcccaggagggtgaggctgcagtgagttgtgatcgcgccattgcacttcaacctaggaattataggcttcagtcactgtgcccggcatgtacattttaatattgtgctttcctcttttagctatagtatgaggttacatttcagagtcattgttgttaagcatcttaatagtgatgaggttgagtgaaagttacttctatttcaaacactgaagaaaattttgtacaaatctgtcacattccaagcccaggactgattgtttcatatacttctaattttacaatttctattgtagtccagtgtgaaaaaagccagtattaaaatactgaaaaattttgatgaagcgataattgtggatgcggcaagtctggatccagaatctttatatcaacggacatatgccgggtaagcttagctcatgcctagaatttttacaagtgtaaataactttgcatcttttaaattttttaattaaattttacatttttttctaatctattattatatgcccagaactttcacttagagtgtgcagtataatgtggtggttaagtataaaggctctggagtgacttcctgggttttaatcttggctctgccatttattggcagccgctaacctcttggtatctcagtttcttcatctgtaaaatgagaataataaagtgaaaagatgccaacatcatttactctgggctgcataactgatacttggaaaaagtattcctttgagtttaagaattaagttggttattcattttagcttgtaataaaaagatagtgattcataggatatgccacttactgaaatttaccacagatccaatcataaaatcactttctcttccctaaagatagcttgattaacatgtaaaggtgtgtaaaggcttgattacactaccctgatccgtaccccagttcccagcagcaccatgaaaaagggatttcaacatatttaattactttcagtagaaagtaacagtggtaggccaggcgcagtggctcacacctgtaatcccagcactttgggaggccgaggtgggcggatcacgaggtcaggagattgagaccatcctggctaacacgatgaaaccccgtctctactaaaaatacaaaaaattagccgggcatggtggcaggcacctgtagtcccagctacttgggaggctgagacaggagaatggcgtgagcccgggaggcggagcttgcagtgagcttagattgtgccactgcactccagcctgcgcagtggagcgagactcttgtctcaaaaaaaaagaaagtaacagtggtattgggagactgaggagcctagaaagtacttgaaggaagtaaaaggtttgtttgaccacattgtatttggaaagccagctttttcagctgtgtcagctttgtgtagtgatttttagttcttcttttagaaaataacggacaaggccgggcacggtggctcacgcctgtaatcccaccactttgggaggccgagacgggcggattacctgatctcaggagttcgagaccagcctgggcaacatggtgaaaccccgtctctactaaaatacaaaaagttagccgggcgtggtggcgtgtgcctgtagtcccagctactccggaggctgaggcaggagaattgcttgaacccgggaggcggaggttgcagtgagccaagatcacaccattgcactgcagcctgcgcgacagagtaagactctgtctcaaaaaataataataaaataaaaaagaatggacagtaaacctaaatgagttcattcccaaagatgatgttattcttaagggatggttcatttatttaagaccttacataaagtctatcaattgcgtgatttttcacttctgtaattgtgtgtatgtataatgtaaatatatatgtttttgttttgttttggttttttgagacggagtctcgctctgttgctcaggctggaatgcagtggtgcaatctcagctctctgcaacctctgtctcccaggttcaagcgtttcttctgcctcatcctcccaagtagctgggactacaggcacgtgccaccacgcccggctaattttttgtatttttagtagagatggggtttcaccgtgttagccaggatggtctcaatctcctgacctcgtgatccacccgccttggcttcccaaagtgttgctattacaggcatgagccaccacacccagcatgtattttttaaatgtataaaatgaagcagaaaagagaaatgataatttttcttcatcttgaaagattatcttcaccaggcgcagtggctcacacttgtaatcccagcactttgggaggcctcggcaggcggctcacttgagttcgaaaccagcctggccgacatggtgaaactccgtctctactaaaaataaataaataaagatggttttaatatatgttttagttttatgattttagcatctttctgaaatttttctcaaggcaagtaaatttgtatcagttggtatattggtacccatctatgaaataacttattaggaagatatctctaaaataagatcactttgcctaaaataaactgatatattgatgttcacagaatttttcttttaaccgacttgataaatgcattattcttgacgtcaagtgatccaccttcctcagcctcccaaagtgctgggattacacacatgagccaccgcacctggcattattcttataaaaggttaaatttctagttaagtttaatgtcctctttgttcatgtaccattgcttattttcttcccttcctactcacagtaatcattcttatggtatgcacttttgtttgcttatttttatgtaattgatattacgctccattctgtacgttgtactttcattcacagtgagttttggacattcctatgttcatctatacagacttacttcattttaactacactgtagtattccgtatgtaatatttactataactcatcactgtagcagagcatctcatagtgtatgtattactgttttgccattttggtatcaatgagtatttaagtcatttgcagtttttccctcttatacccagtattacagaggatctctttttatatgcttctttgtaccaagaggcagattaaaaaatttttttttgaaaaaatttttgaaaaaaaatgaaatgaagtctcactatgttgcccaggctggtctcaaactcctaggctcaagcaatccttccatcttggcctcccaaagtgctggggttacaggcatgagccaccatgcctggcctacattttaaattttgatagctcttacaatttactttgtaaagtatctgcatcattttatgttctcaccagtctttaataagaatacttcatacttttggctggacacagtggctcacgcctgtaatcccagcactttgggaggccgaggcgggcagatcaagagatcgagaccaccctggccaatatggtgaaaccctgtctctactaaaaatacaaaaattagctgggcgtggtggcgcacccgtagtcccagctactcgagaggctgagacaggagaatcacttgaacccgggaggtggaggttgcagtgaacttagatcacaccactgcactccagcctagcaacagagtgagactctgtctcaaaaaaaaaaaagaatacttcagacttaattttttttccagtcttaagtgtttgctaatgagattgagtttcttttggtatgtctcttgattgttcaggttttttcttttatgaattgactgttcatctctttttcacattatttctgttgggtgattttattagtgacttgttaaaattctgtatattttttcagcatgacacttcattattcaaaaaaaaaaaaagattctctatgtttctcgatactaatcattggttggtaataccttaaaaataagacccttactgtattttttgcttttttttttttttttttttttttttttttgagatagagtcttgctctgttgcccaggctggagtgcaatggtatgatctcggctctcagctcactgcaactgcaacctctacctccctgtttcaagcaattctcctgccttagcctcccaagtagctgggattacaggcatccaccaccacacccagctaatttttgtatttttagtagagacagggtttcaccatgttggccaggctggtctcaaactactggcctcaagtgatccgcctgcctcggcatcccaaagtactgggattacaggcatgagccacagtgcctagccactttttgctttttaactttgttttatagtactatagttttagtataaacagatgtatgtatacacacaactatggctttataatatgtttcagtcattgttagagcaaggcctaccttttgggtgcttcttttacaaaattgtcttggctattcttgtgccttttttcttatttgtgaattttagaattgtgaattacctgttgactcaccatgttttgtaaactgaggattttgaatggaattgcactcaattaaagattatcttgctttctgtgcagcaatgttttatttcaaataatccctactttaaattacttaggatagctataaattgtgtttctggctttctagatttagatgaaacgctttaaattgattgttttctcctaaatttaaaactgattgttagaagttaaagtcttctgttcattcttatttaggaagatgacatttggaagagtcagtgacttggggcaattcatccgagaatctgagcctgaacctgatgtaaggaaatcaaaaggtttgtggtgtttttatacttcatattaagcctttactcacattagtgattgactgtaagtcaaagaccacttaaggtttaaactgtttattttgtaaagtaaccactgtatctttcaccttgtgtttatagtcagaagtaagtacaagggcttcctgtagtcacatctttatgcaatctcctctgaatcaaaagttagtgaacttgctttgccactccagaaggcacatgaatatgaaaaagcattgtctattttcttatttaatggcaaaatacccgacctaagttggacttaatgtttgagaccgtttattttattaaattatattttttctcttttcttttttttttttgagacagttcttgctctgtcacccagaccggagtgcagtggtctgaccgcacctcactgcaacctctgcttcctaggttcaagcgattttcctgcctcatcctcctgagtagctgggactacaagtgcgcaccaccacacctggctaatttttgtatttttagcagagatgaggtttcaccacgttggctaggctggtctcatactcctgacctcaagcaatccatccgccttggcttcccaaagtgctgggattacaagtgtgagccaccatgcctggccttattaaattatttttattaaatttcctcaagattgatgaaagtaatgaaatataaaagtaatgaaatatatgtggaaaatagactggattaagaaaatgtggcacatatacaccatggatactatgcagccataaaaaaggatgagttcatgtcctttgtagggacatggatgaagctggaaaccatcattctgagcaaactgtctcaaggatagaaaaccaaacaccgcatgctctcactcataggtgggaattgaacaatgagaacacttggacacagggtggggaacatcacacgctggggcctgtcgtggggtggggggctgggggaggaatagcattaggagatatacctaatataaatgacgagttaatgggtgcagcacaccaacatggtacatgtatacatatgtaacaaagctgcacgttgtgcacatgtaccctagaacttaaagtataataaatttaaaaaaaataaatatatgtggaaaatattaataggtcaaaattcaaattgttcatttaatcagaagagtagtttagtcaaatccaagggttagacaacagaaatcttttttgtcaagtgcattctttgtgactgatttcattttcttcctggtttacacaggaagatttcagaaacaaatgtggatccgtgacagatggtatctagaagtttttagtttggttgaattgacagtattttattgagtaaaagatactaatttttgtaagaagaaaaattcaattttgataagtatgtttaagattaagagctattggccaggcgctgtggctcatgcctgtaatcctagcactttgggaagctggagcaggtgggtcacgaggtcaagagattgagaccatcctggccaacatggtgaaaccctgtctctactaaattagccaggcgtggtggcacatgcctgtgcacccgcctccgggtttaagcgatcctactgcctcaggctcctgagtagctgggattacaggcgccatggctaatttttgcatttttagtagagacagggtttcactacattggccaggctggtctggtctcaaactcctgacctcaggtgatctgcccgccttagcctcccaaagtgctgggattacaggcatgattcaccatgtctggccatttatcttattttcttttttttttttttttttgtttgagacggagtcttgctgtgtcgcccagagctggagtgcaatggtgcgatctcagctcactgcaacctctgcctcctgggttcaagcaattctcctgcctcagtcttccaagtagctgggattacaggcgcgtgccaccacatctagctaatttttgtatttttagtagagacagggtttcaccatgttggccaggctggtctcggaactcctgacctcgtaatctgcccacctcggcctcccaaagtgctgagattacaagtgtgagccactgtgcccagccatcttattttctttctttttttttgtcgggtgggagggggacagagtctagctctgtcgccaggcttggctcactgcaacctctgccccccaggttctagcaattattctgcctcagcctcccaagtagctgggattataggcacctgccaccacgcctggctaattttttgttatttttagtagagatggggttttgctatgttgaccatgctggcctcaagtgatccgcccaccttggcctcccaaagtactgggcttacaggcgtgagcttgtattgggtaaaagaacaatattgggggctgcatggtggttcatacctgtaatctgagcactttgtgagactgagatggaaggagtgttggagcccaggagggtgaggctgcggctgcagtgaattgtgatcacgccattgcacttccacctaggtaatggagcaagaccatgtctctaaaaaacaaaacacaatttttttaaggaatactgggaagaggtcagtggtggttttagaacagaggaagtgccagatgacctttgtgaggcattggccaggaagaactctacagtgtctttaggtagcttctgtccataaggataatggggtctcctccccagtattaatagaaaatctctgagctgtttttttttgtttgtttgttttgtttttttttcctgagatggagtctctctctgtcggccaggctggagtgctgtggcgcgatcttggctcactgcaagctctgcctcccaggttcacaccattctcctgcctcagcctcccaagtagctgggactacaggtgtccaccaccacgcccagctaattttttgttatttttagtagagatggggtttcaccatgtcagccaggatggtctcgatctcctgacctcgtgatccgctcgcctctgccttgcaaagtgctggagttacaggcgtgagccaccgtgcctggcctggtttttttgttgttgttatttatttatttatttatttattttttgagacagactctcgctctgtcgcccgggctggagtgtagtggcacgatgtcggctcactgcaagctctgcctgccaggttcaagccattctcctgcctcagcctcctgagtagcagggaccacaggcgctcgccaccacgcccggctaattttttgtatttttagaagagacggggtttcaccgcattagccaggatggtctcgatctcctgatgtcgtgatccgcccacctcggcctcccaaagtgctgggattacaggtgtgagccaccgtgcctggcctgatttttttttttttttaatctggtctcatacctctgacagctcatgaagaagtgctcctgcttcatatgtatatgtgttagcatagtgttaacatagcataggtgttcggtgtttgcagtttctgtttgttttatatgaattaaggtgtattatgagcagttgaagatatataggaaattttttcccaaaccactatctctgctcgttctattcattcagtctgtttatgttattccttcattcattcattttatagaacagtggagtgcctactgtatgcatctattgttctgggtcctggggaagaaaacaaagttcctgctttcatggaacttacattatattggcggagacagtaacagacaaacaaatgtagcctgtgtacatgtgttacatgaaaagcagggtagggggctgggagagagtagtagggagtgctattttcgaggtggttgtcaggaaaggcctcactgaggaggtggcattttgagtagacctgagcgcagcgggggcgtaagcccaggcagcatgtggaggaagagtgttcttggtgaaaggaacaaggatagaggcccgaagctagagagctcagcatgatcaaggaacagcaagccccgtgtggctggaatggagtgagcaaaggaatgagcagtagaaggtgagtgagttgggaggtcaccagagaccatggcaaggacttgaaagtgtcagggacacattggaagttggagcagggaaatgatgggatttatgttttgtttttgttttatgtttagtgtttttaagggattgctctatcagctatttggaaaatttagtgtagggcttcaagaagagaagcagagaaacaacattcttgccatagtcatagtctaagtaagggatgatggtggtgtggattaggctggtagtggaagaccagtccagttcgggttgtatttgaaggtagaggcaaaaagattatatttctaccagcaagcccatctatgaagttacttgtattattaatttaattgagacatgcccacataaactaataaataggaatttctgcagtttggttaaacacccctgtatatcctggttcttcttttagttgtccagatgtctctttaagtcaagtattttttggtggtgtaggagcctagagattgaatttattcacccaaaaggcatttgagtgattactatgtgccaggcactatgctgaatgccaaggatgtaaataagagggcgtagtctcagtctgttttactccagcttggttcctttttaatgaccctgacttgttaagcatatcagttatcctacagaatgtttaatcttctgtactttcctggttgtgttatttagcttatttctctttccttgacatttcttgtaaactggaagttacacctatagtcttgatgattcgtgttacacattttagattagaacacatcatgtgttgtatatggtgtttttgaaagcctctctgtatattggtctgtacattaaaatgttgcctgaatggatacacataaaatttaacagtgattacattagagatgagaagaaagaggtgccttttacttttcaatataccttttcctctgctttttgaactttcttgccctatgcatacgttattgcttaatcatccacctcatctcttcccctgtggctttctgttgcatttggaatgaaatctagcctctttgctgttacctgtggatgtcccttgctggcctctatcaccttactttgaaccactcctttcatggactgagctctcattggactatcttttattcttttgctgaagtttcttcactttgagtgcctctgcagttgctatttcatggctgtggcaagccctgccatggctttcatgcaaggatggttcctccttctcatctcaatattatctcttcagagagggaccttcccaactccgatgatctaaaatcctttgtatataccactcactaccacttctttcttttcttttccttttatcttttttttttttttttttttttgagatagggtcttgctctgttgcccaggctggaatcacgactcactgcagcctcatcttcttgggctcaaatgatcctctcacctcagcctctcgagtagctggaactgcaggcacacaccaccatacttggcttattattttactttttgtagagacagggtttcaccaaggctggtctcaagctcctgccgcaagcaatccacatctctcagcctcccaaagtattgggattataggagtgagccactactcctggcctattttcttattcactgtctaaaattatcttgttcatttatttacatacttgtttatagcttatttctcagctggacatggtgcctcacacctgtaatctcaatactttgggaggctgggttggagaattggttgagcccaggacttcaagaccagcctgggcaacaaagtgagaccctgtctataaaaaattgtttaaaaattagctgggcatggtggcacatgcctgtggtcccagctacttgggaggcagaggtgggagaatcgcttgggcccaggaggttgaggcgacggtgagccatgattgtgccactgcactctagcctagtgacagagtgagaccatgtgtctaaaaagtaaataaaaatagtttctctttcatgactagaatattacctctatgtgggcagggagtttgtctatactatttggcactatatttcctgattctgaaattatgcctagcacatggtaagtactccttaaatatttattgactgaattatttaatacttaagaatttcatttgggattatctgagtggtaagattacggattatatttatgtaagaaaaaatcattttttaaacttggttgccctttgccacactgacatagacactaagttttcttagccagattacttccgaggatactcacagaggccattctcttctcaatccccaaataattgatatttcttagcactttcaagctaatgcaattcttagatgatgtatctgtgtatatcatatcctcattctacaaatgtagaaattgaagtctgggcacagtggctctcacctgtaatctcagcagtttgggaggccaaggcgagcggatcactgaggacaagagttaagaccagcctggccaacatggtaaagccttgcctctattaaaaatacaacaattagggccgggcgtggtggctcacgcctataatcccagcacgttgggaggccaaggcaggcagatcacgaggtcaggagttcgagaccatcctggctaacacagtgaaaccccatctctactaaaaatacaaaaaattagccaggcatggtggcacgcgcttgtagtcccagctatcgggaggctgaggcaggtgaatcccttgaacccgggaggcggaggttgcaatgagctgagattgcaccgctgaactccagcctggtcaacagagggagactctgtctcaaaaaaaaaaaaaaaaaacaattagccaggcgtggtggcgggtacgagtacctgtaatcccagctactagggaggctgagggaggagaatcacttaaacccaggaggtggagtttgcagcgggctgataatgcaccactacattccagcctgggcaacagagtgagactctgtcttaaaaaaaaaaaaaagaaagaaagaaattgaggaatgtggagattgtggtctgtgatttgttaggaatcacacagcaggttagtagcaactacagggctttggttcagaataccaccttgacaatggtttgtttacagttcggctccccttcctctgcctttctctccttccttattgagggcagctggaaagaattttcatcatttactagcctatagctttaatttgagttttgaaaccttgataatagagcacagaggaaaagactgagttttctttttttgagacagtcttgctctatggcccaggctggagtgcagtgacaccatctcagctggttgcaacctctgcctcccaggttcaagcaattctgcctcagcctctcgagtagctgagattacaggcacgtgtcaccacgcccagctaattttctgtttttgtttcgttttgtttttttctgagatggagtcttgctctgtcacccaggctggagtgcagtggtgcgatgttggctcactcaaacctctgtctcctgggttcaagcaattcttctgcctcagcctccccagtagctgggactacaggtacgtgccaccatccctagttcatttttgtatgtttagtagagatggggtttcactatgttgaccaggctggtctcgaactcctgatctcaggtgatctactcgtctcagtttcccaaagtgctgggattattggcacacgcctatttttgtatttttagtagagacggggtttcaccatgttggttagactggtctcaaacttctgacctcaagtgatttgcccgccccagcctcccaaagtgctgggattacaggcgtgagccaccgtgcccagccaagattgagttttgaaaagagccttctgagattatgagaagggcaagcaagataacttaagaagttacattaaaatcatctaagagacagtgtaacaagaaggaattgtaaaatgatgttatgagcacgtgcccaatgtagtggcaatcccttgtgcttcgatacattggtgggagacaaaactgtacttaaattgataaatcccttacatgtcattttaaggagcttagactgactcccatcatgtagacatcagagatttcttttttttttttttttttttttttttttttttttgtgacagagttttgctcttgttgccgaggctggagtgcaatggcgtgatctcggctcaccacaacctccacctcccaggttcaagcaattctcctgcctcagcctcccgagtagctgggattacagccatgcaccaccacgcctggctaattttgtatttttagtagagacggggtttctccatgttgtggctggtctcgaactcctgacctcaggtgatcctcccgcctcagccacccaaagttctgaaattacaggcgtgagccaccgcgcccagcccagagatttctaaacagagttctaaccagatgcttttccctgtcagtagaatgagaatgaattggaggtgggagagactggcatgagggacaccagtcagccagtggaattagctggtaatgttgataggagaagaaaaagattcaaagttaggtagtggtagcaagaattagagggaaggtcggatttatgatatgtccaaggttgaattctaaggtgaaatttggtggcagatttcatgtgtaaattgggaaggtagattgagtttttttaacatgggttttctaacatgtcaatagagtgactctgcaggggggcctgacgagagaacagtgcatggggtgattcaacagccagttgagccttcatgcagagcatttaacactgtgactctgtagactctggttggcagtaaaatttcattaaaccaatatttaaacccttaggtaataataaaaattgagggaaaaggatccaggttttgtattttttatgaattcagttattgaattaaacaggaccttgcctcaagaaataatctaccaacaattaacttgttttaaagcaaagttaggaagtgagcatgttcaaattattaaataaaaaagtaagctgtgtatttcattcatagaaatagaggctggcctacttcggatgattctcagcatgtgattacagatgtgggcttatacatcctagggagttaaggcgtactctggcttggatagagtagagctctttgaaactcttctctcacccagctagtttatatagactagagaactagaatgtagcagcatactctgtcttagaagcccttttatataggagctggtctggaaggtttgaaaacataacaaatgtgttggtgtctcccaatgtattgctagattcttacccaagagcattatcctggttagggtttggtttggttttgttttgttttttaatgtttgccacaaactaacactagatgttagttctttcatcaagtgaggagagtagaagaaaagtccagaactctgaaacaccttttcaaaagtttttcaagccatgatgtttgcaagttaaatgctctgttatgtaagcaatataatcagtttttattaatgtaacattccttagtgttttggggtatcacacaaaaaagaatatccatatctggaagcaacagcttttaaataagagcattgtggtggtggtggtgatagtggtttttttttttttttttgagttggagtctcgctctgttgcccaggttggagtgcagtggcacgatctcagctcgcttcaacctctgctcccaggttcaagcaattcttctgcctcagcctcctgagtagctgggattataggcacctgctaccatgcctggctgatttttattattttagtagagacaggtttcaccatgttggccaggctggtcttgaactcttaacctcaggtgaatcacccacctcggcctcccaaagtgctggaattacaggcatgaaccaccatggccagccaaataagagcatttttaatgtaaaattatgcatgaaatgtacattcaattttgtctttgtttactaggatccatgttctcacaagctatgaagaaatgggtgcaaggaaatactgatgaggtaaatcctacctttaggataaaaagatttctgtttataagtgccaccctcatgtaagtgaggtttaaaattttccttttctttaggtcccatgtttaagcagcatggcacatttatgttctcttacccagaatgtaccaagaaagggtggtcccttcttaacatctaacaattgcctggtagtagcagtgaaggtatcttcagtcagaggctaggaccactgaaggatatacatgcattcaagtttccatcagccagcaggcatcagtaatcagtgtgtagatcaaaagctcaaatgtttccttccccactggcagttttacttcaagtagtggaggcttgcttttttaatagttaattaagtacattgagagatgggaggtgaaaaaaggaaaatgttttattttgaccatctaatatgaaagtagttcggtgttaggtatccagtagttgacactggaagacagggaatgacatgttaatattcatagccagagggtggcccaggttttttcgtacatgggaatgaaattcttatccaaataagtagaaattatgtgcgtaagccatttgttaagagcactgagtatgtgcatctcgatccatctaatgaataaccattatcaccagtttaaattattttctttaggcccaggaagagctagcttggaagattgctaaaatgatagtcagtgacattatgcagcaggctcagtatgatcaaccgttagagaaatctacaaaggtaaggatgacttcgttttgtgtaaactaaaaagtattattttccaggtgtaaaaataaaaaagaacataaggggtttctttgcctttgaaggattaactgctgtggggattaccttcttatcataagcaactagaaaattgacaaactaaatgaaacaactgtttgcatatattggacaatgggcaatacagggaaaccatggaaaccaaacagagcccagtagtcttgctgaacgaaagagttaaatatcaaagttcaggccaggtgcagtggctcacgcctgtaatcccagcactttgggaggccaaggcgggtgaatcacttgaggtcaggagttcaagaccagcctggccaacatggtgaaaccctgtcttagccgggtgtggtggcaggcacctgtaatcccaactatttgggaggctgaggcaggagaatcgcttgaaccagggaggcggaggttgcagtgagccgagatcacaccactgcactccagcctgggcgacgagcgaaaccccatttcaaaaaaaaaatcaaagttcagagagctcaatttgagtagaagttgtaggataaggtagcagaaaagaggaagctgcccagaaagaaagccgtagagatatttagagagattcccatggatccttggcctaggagtgatctgtatatgtgtggggtgaaaacgcatgtgtccaggtagagaaccccccagaaattagtaggctgaatgattgctggaacatagggctaagaaaagttcatggccagaaggatctggccagagtagagagacttagtaatacacaaggcattgggtagtgtcttcacagaggttatgccttactactgaagataaattagtcctagagtacaagcacctgaaccaagtttcaaagcaaatttttaaagggtcaaattacctaacaactgcatgccaaaacaaaggcctaaccctctttacagtaacacaacaaaattcagcacttcacagtgtaaagttagaatgtctgacgtccaggctgggcgcagtggctcatgcctgtaatcccagcactttgggaggccgaggcaggtagatgacctgaggtcaggagttcaagaccagcctggctaacatggtgcaaccccgtctctattaaaaatacaaaaacttagccaggcatggtggccggcacctgtgatcccggctacttgggaggctgaggcaggagaattgcctgaacccaggaggtgaaggttgcagtgagccgagatcgcaccactgcactctggtctgggcaaaaagagcaaaactcaggctcaaaaaaaaaaaagaatgtctgacgtcaatcacaaattaccaagcatgacatgaagttgacctataaccaggagaaaactcaatctatagaaacagacccagatgtgagaaagatgatgaatttagcagacaaagaccatcaagtggctattttaaatattaaaaatatgttcaagtggccaggtgcagtggctcatgcctgtaatcccagcactttgggaggccaaggtgggtaggagttcaagaccagcttggccaatatggtgaaaccccttctctactaaaaatacaaaaaaattagctgggcatggtggcaggtgcctatagtcccagctatatgggaggctgaggcacaagaatcacttgaacccgggaggtggaggttgaggttgcagtaagccgagattgtgccacttgtactccagcctggacaacagagtgagactctgtctcaaaaaaaaaaaaaaaaaagttaaagaaaacaagagtataatgagaaaaatgcaaaatagttttaaaagaaccaaatggaatttcttaaaataaaaaataccagaaatgggggccgggcgtggtagctcacgtctataatcccagcactttgtgggggctgaggcaggcagatcacctgagatcggtagttcaaggccagcctgaccaacatggagaaacctcatctctactaaaaatacaaaattagctgggcgtggtggcgcattgcctgtaatcccagctacttgggaggctgaggcaggagaattgcttgaacccgggaggcagaggttgcggtgagctgagattgcaccagtgcactccagcttgggccacaagagtgaaactccgtctcaaaaaaaaaacaaaaaaaaacagtagactcgaagaactagctgagtttttctttactttaggcagtaagtgtgaccttttgcaggtgactactttagttcctcatgtcctcattagtagatcagagaaattcgacaccaaaaccccaaaagaaaaaccccttctaatcctcattccatgattttatgaatgcatgaagtcctaggcctgcgaaggaatactcattctctttatcctgtgttgatacctctctgcttcaacctccaactcgacatttgcctataggatgtacttggacattcagcataaactacctcacaccattactgaattgcttcatgtgcacatgtcccatgccacaataccggggaccttgtcttccgtgatatttgtccgcagtgctgtgactacaggagggagtcagtgaatgtctgcatgtgtgtctttaccatccctcttgaatatgctctagggttaattcctagaagtagaattactctattgaaaattggcaatatttttcattctaatatctattgccaacatgggaaagcaagtctggatgccagtccttgttatatgccccttgggtaagttacgtaacctctttaagcttctgttcactcatattttaacaaggaaaattacaatattttacctcacaaaattgtagtcagcttctggctgtcttaaactctggtatatagtaaacactaagtgttggtgtccatccttaatttgtaataataggtcacttgttagagaaatgcaccttaccattttcttttcttttcttttttcagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaaaatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggcaactcttgctgcctctgcatgttttggaataacaatttctacaagactctaggctgtttaaactagtgctttcagttaagataaattctaatcatttctttgtatatacattttgtgcttctgagctagagatgccaagtagttgtaaactgcttataaagagaatagcagcaaatttgagactcggctacttttttctgccccacctgctttgagacacagaagcggagtgtggcccgaaattattagccagatttaatatttgatctaaagtaggtccttgtactcattttaaagttggaatttgattcctccaacattgagcacccaccatgttccaggctctgtgcattgtgcccacaaaataagattccctggtggagtttttatgggttcaaataatcagttgaacacccttcatctttatcatgttgttgacattgacacaaattgtttaaaaagaaaagatattagagagaaagtggtacctttgtaacttgatgtgtcttcatcattcggtaagatttgatgaaagtaaaaagcaaatgtcagccaaatccagtgaacagcaataaaacagggagtaactttttataactttttctacttggatttcaacattcagtagagcttttcgaaatgtaagtagtttacagtactggaggtttgactagttcagtaggaatttggaggggaaggtcattctgaattgtaacaaagtacaaacttctttgctgttttatttaagtactgagagctaagcacctgatgaagtgactgacctctctccagtgacagtgtttgggtacctgcctgacttcaggagtggggtttatgtttctacacagtgaccttttctctcgccctctcctccctcttgcccacacaccagttgattggacctgggttgaactcctgatccagacaggcccaagacagttcttaatgttaagaattttggggccgggcacggtggctcatgcctgtaattgcaacactttgggaggccgagacaggcggatcacttgaggtcaggggttcgaggccagcctggccaacatggtgaaaccctgtctttactaaaaatacaaaaattagctgggcatggtggcgcacgcctgtaatcccagctacgtgggtggctgagacaggggaatcgcttgaacctggaggcggaggttgtgcaatgagccgagaccgtgtcactgcattccagcctgggtgacagagggagactctgtctccaaaaataaaaataagaaaaagaattttgggctaggtgcagtggctcacgcctgtaattacagcattttggaaggcccaagatgggcagatcacttgaggacaggagttcgagaccagcctggacaacatggtgaaactccatctctactaaaaagacaaaagttagccagatgtggtgatgggcacctataatcctagctcctcgggaggctggggcaggagaatcacttgaacccaggaagcagagattgcagtgagccaagatcacatctctgcactccagcctgggcaacagagcaagactctgtctcaaaaaaaaaagaatttggccaggcgcagtggttcacgcctgtaatcccagcactttgggaggccaaggcaggcagatcacgaggtcaggagatcgagattgtcctggctaacatggtgaaaccctgtctctactaaaaatacaaaacattagccgggtgtggtggtgggcacctgtagtcccagctactagggaggctgaggcagaggaaggatgtgaacccaggaggcggagcttgcagtaagccaagatcgtgccactgcactacagtctgggcgacagagtgagactccgtctcaaaaaaaaaaagaattttggccgggtgcggtggcacatgcctgtagtcccagcactttgggagaccaaagtgggcggattacctgaggtcaggagttcaagaccagtccggccaatatggcgaaaccctgtctcttactaaaaaaaatacaaaaattagccaggtgtggtggcgggcacctggggaggctgaggcagggagaaatgcttgaaccggggaggcagaggttgcagtaagccaagatcgtgccactgcactccagagcaagactctttctcaaaaaaaaaaaaaaaagaattttgcatggggaaggagagatactgttcaccatctggaatggtgcttggatgtggcacttacaaaatcaggagccagcactgcatggacaaacagaagcatgtgggcctgagatagcaggtaccttgataaccctgaagacatccttggtttctgcatctattcctgcatccttgcattggactacattaatctgtcagttatccttataatgatttttgattttttttttttgagatggagtttcgctcttgttgcccaggctggagtgcaatggcacgatctcggctcaccacaacctccacctcccaggttcaagtgattctgctgcctcagcctcctgagtaactgggattacaggcatgcgccaccacacctggctaattttgtatttttagtagagacggggtttctccatgttggtcaggctggtctcgaactcccaacctcaggtgatcaccctgtctcggcctcccaaagtgctgggattacaggcgtaagccatggtacccggtctgttttttgattttttgaaaccagtctgaagtgagtttttttaattacgtgaaaggagtttggctaaaatactgccatactgccctaatgcctaatgattatgtattctcagcatgtctgcaaagtactgctgatttctggagaataatttttctttagtaaacttcacttaagtcgtcatgtgtattctctcaaaatggtatcctaacctaatggagctaaaagacaccccttgtttttataacaagcagttactgaggcccaggaaggggagaagtccctggcttgtgagatgatcaccattagaactcaggcctgggccagtgccttttcatgcttctcagatccttccaaagaataatgaagattataaccgcttttagcaattgtaataaacccagaaatagaaagctttttggttagagtactggtagaagtttggcgggagagataatttttacaaaatttgtaaatacctgccaattctatatactaggcaaggtctctggccttgtaaaacccctcaaggttacaactttggtggcccacactaatagttacccactgaggccctctccgggtgaacattgagcactagaggaagcccctctgcttgggcaggactgggcgtggtgcagagtaggagcggtgatactgtggattctgggcaggtggagatggccagtgatgtccaataaaggacactggagggagcagtgtgagtaaaggccctgagggcattcatgttcagggagggttgctgcccactggcttgcttggcacacaggagagtgggtattcctgccttagtaactttatgtaaacaagtatttcctcagtctgttcctctcaaactgcctgctctggcacattcagaatgtcacagaactcacctggatgcattcagccccttgcctaaaggtgacagtgcatctccttccccaccccacccctcataccactgaagcacctgtcagactggcccagtctgtgggcaaggagcctagagagggcttagtttcagcttgaaaggagctgggatttaccaagaagcaaatgagagacgaggattgcaacaactgtgccatttccccagcttcagctgactcctgtatattgactgtgccttcagactcatccgtaagtgaccccaggctggcctctcccacatcacagtaagaattccacacaccatacaacttggaaagaggctccagctgaaggaagccccacacttctttcaagtttttcttagtcttctcttcttggcaaagagtaccttttgtttcttctaattatgtaactattggtttagtaaatattcacccattcagtcaccctgtaagtggcaggcactgtttacagggacacaggaaggaataaaaacttgcaggcaccttggagcttgcattctattgaagaggtaatggaagttgggatagcagctaaactatgctggtattggccaggcgcagtggctcacacctgtaatcccagcactttggaggccaaggtgggcagatcatgaagtcaggagatcgagaccatcctggctaacatggtgaaaccccgtctctactaaaagtaaaaaaaaaaattagccaggtgtggtggcgggcgcctgtagtcccagctacttgggaggctgaggcaggagaatggtgtgaacccaggaggcgaagattgcagtgagccgagatggcaccactgcactccagcctgggtgacagagcgagactctgtctcagaaaaaaaaaatatgctggtagttttgattcaagatggcctttggagcccatgatttaggtctcgtacccaccaaggtctactggaaaacatcaggctctcctgctatagacccatagggagagctgcagccgagagggggagctgaagagaagtgccccttctgtgtcctgtcagcctcatccttccgcaaggaccagttgctgtgccactccattcacttgctgcaagactggaggtttttcctcaggtgttgagcacctggtttacaagatgtcagcatcttgatgcctgagaccatcaaggcaagtctctgaacagggcttaccttagagtaaggcttagaagaggccgtaaagtcagtctcagctccgtggctctgcagagctttgggacatgtgaattcttaaaaacaagactattgtacagttactatatgcatgcagtataaaattataaccttggaaaatcctagctagctgttgagctaattccataaagtaatcagctcctgagttctgcagtggtaataataatcagcataatgagtaaacactgtgtgtgccaggcagcgtctcatttgatccttgtgataatcttgtaagtactgattttctcccttctttaaacaaagttttttttttttttttagagagggtctcactatgttgcccaggctagtcttgaattc

SEQ ID NO: 18 - DNA, 162025 bp, Homo Sapien
  allele 156,277: Nucleotide sequence of chromosome 17 containing the genomic sequence of the allelic variant AKAP10-1
gaattcctatttcaaaagaaacaaatgggccaagtatggtggctcatacctgtaatcccagcactttgggaggccgaggtgagtgggtcacttgaggtcaggagttccaggccagtctggccaacatggtgaaacactgtctctactaaaaatacaaaaattagccgggcgtggtggcgggcacctgtaatcccagctactcaggaggctgaggcaggagaattgcttgaacctgggagatggaggttgcagtgagccgagatcgcgccactgctctccagcctgggtggcagagtgagactctgtctcaaaaagaaacaaagaaataaatgaaacaattttgttcacatatatttcacaaatttgaaatgttaaaggtattatggtcactgatatcctgtttcattctttatataatcattaagtttgaaatgtatacttgcactactaacacagtagttaatcttagtcctacaagttactgcttttacacaatatattttcgtaatatgtatgcactggtgtttatgtacgtgtttatgtttatatctgttaaaattagcagtttccatctttttctattttgtaccatcacatcagttcagaaggattgacagagcaaaatgatttgatgaagtataaaagtcacatggtgagtggcataaatacaactctgaacaattaggaggctcactattgactggaactaaactgcaagccagaaagacacatatcctatatgtcaagagatgtaccacccaggcagttaaagaagggaagtacacatagaaagcacaatggtgaataattaaaaaattggaatttatcagacactggattcatttgctcctaaagtcagagtcctctattgtttttttgtttttgtgggtttctttttaaatttttttattttttgtagagtcggagtctcactgtgttacccgggctggtctagaactcctggcctcaaacaaacctcctgcctcagcttcccaaagcattgggattacagacatgagccactgagcccagcccagacgctttagcatttatgaagcttctgaaatagttgtagaaaccgcataagctttccatgtcactttcaaagtttgatggtctctttagtaaaccaaccaagttattcctcaagggcaaaataacatttctcagtgcaaaactgatgcacttcattaccaaaaggaaaagaccacaactatagaggcgtcattgaaagctgcactcttcagaggccaaaaaaaaaggtacaaacacatactaatggaacattctttagaagagccccaaagttaatgataaacattttcatcaaagagaaaagagaacaaggtgttagcaaattcctctatcaaataacactaaacatcaaggaacatcaatggcatgccatgtggaagaggaagtgctagctcatgtacaaaccagtagataatttcaacttgctgccgaatgaaacctctttgcaaggtatgaatcagcacttctcatgtttgttttgctttgttttgttttgtttttagagacaggcccttgctctgtcacacaggctggagtgcagtggcacgatcagagctcactgcaacctgaaactcctgggctcaagggatcctcctgccttagcctcccaagtagctgggactacaggcccaccatgcccagctaattttttaaattttctatagagatgggatctcactagcacctttcatgtttgatgttcatatacaacgaccaaggtacaatgtggaaaagggtctcagggatctaaagtgaaggaggaccagaaagaaaaggggttgctacatagagtagaagaagttgcacttcatgccagtctacaacactgctgttttcctcagagcagagttgatgatctaaatcaggggtccccaacccccagttcatagcctgttaggaaccgggccacacagcaggaggtgagcaataggcaagcgagcattaccacctgggcttcacctcccgtcagatcagtgatgtcattagattctcataggaccatgaaccctattgtgaactgagcatgcaagggatgtaggttttccgctctttatgagactctaatgccggaagatctgtcactgtcttccatcaccctgagatgggaacatctagttgcaggaaaacaacctcagggctcccattgattctatattacagtgagttgtatcattatttcattctatattacaatgtaataataatagaaataaaggcacaataggccaggcgtggtggctcacacctgtaatcccagcacttcgggaggccaaggcaggcggatcacgaggtcaggagatcgagaccatcctggctaaaacggtgaaaccccgtctactaaaaattcaaaaaaaaattagccgggtgtggtggtgggcacctgtagtcccagctactcgagaggctgaggcaggagaatggtgtgaacctgggaggcagagcttgaggtaagccgagatcacgccactgcactccagcctgggcgacagagcgatactctgtctcaaaaaaaaaaaaaaaaaaaaaagaaataaagtgaacaataaatgtaatgtggctgaatcattccaaaacaatccccccaccccagttcacggaaaaattctcccacaaaaccagtccctggtgccaaaaaggttggggaccgctaatctaaataatctaatcttcattcaatgctaaaaaatgaataaacttttttttaaatacacggtctcactttgttgcccaggctggagtacggtggcatgatcacagctcactgtagcctcaatcacccaggccccagcgatcctcccacctaaacttcctgagtagctgggactacaggcacgcaccaccatgcccagctaatttttaaattttttatagagatgggggtctcaccatgttgcccagactggtctcaaaccctgggctcaagtgatcctccctcaaactcctggactcaagtgatcctccttccttggcctcccaaagtgctgggattacaagcatgagccactgtacccagctggataaacattttaagtcgcactacagtcatggacaatcaggcttttcaacatgcagtatggacagtgagtcccagggtctgcttttccatactgaaatacatgtgatactaaggagaaaggtgctcgcaaggatatttaaaatgaagaatatttaaaatgaggaaaaaactgtttcttcatgactttgataaggctgataaagaccatttctgtgatctcaggtgattcactcaagtagtatatttcagtaatcattatctggaacagcctgaatcttaaccaaaataccatgattttttaatgctgttatgataccttgatgatatgaccaaactgcaatgtaggcagctaaatctccacgagtttgacttccccgagagttgacagttttcttcacaaattaaagaaatatattttttgatacatgattggcatatttaaaaactacactgaaatgctgcaaaatgatataaagaaacattttccagaatcaaatgcaatcaaagagtggattaggaatctactcaccattatcaactaaatagaaacacttggactgggtgtggtggctcacatctgtaatctcagcactttgggaggccaaggcaggtggattgcttgaggccaggagctcaagaccagcctgagcaacatagcaaaactctgtctctacaaaaaaaaaaaaaaattaaccaggcatggtggcagatgcttgtaatcccagctactctggaagctgaagtaggaggactgcttgagcccaggagatcaagactgcagtgagccgtggtcatgctgcgccacagcctgagtgacagagagagaccctgtctcaaaaacaaaaacaaacaaaaaacacttaaccttcctgttttttgctgttgttgttgttgtttgtttgttttgagatggagtctcactctgttgcccaggctggagtgcagtggcgtgatcttggctcactgcaagctctgcctcccgggttcacgccattctcctgcctcagcctcccgagtagctgggactataggcgcccgccaccacgcccggctacttttttgcatttttagtagagatggggtttcaccgtgttagccaggatggtcttgatctcctgacctcgtgatccacctgcctcggcctcccaaagtgctgggattacaggcatgagccaccgcacccggccaacctttctgttttttagtttgatatgcttgttaactcagcagctgaaagaatgctgaaagtggccttcagtaaaaaaatttcactagaatctctacatccatatttaatctgaatgcatatccagattgatcagttagagcaaaaacactcatcatcattcctgatgacctctaattctggtttcggctttctatttcaatggaaacagaataaggaaagaaatggaagggctctggaaatttgtcctgggctatagatactatcaaagatcaccaacaataagatctctcctataaatataaaacaagtataattaattttttaattatttttttctcttcagaggattttatttcaagataaaacataacttctacccatactattgattccaaaggttagaaaaagtgtttttcctcatcttatccttcaaagaggtcacagcaatgcaaacatctataaaatgcctctgcataattgtcagaagctatagtccagaaatcattgaaaatgcttttccattttaagcttaggtgaggtgtcttaggaaacctctatgacaacttactctatttattgggaggtaaactcccagactctcccagggtctcctgtattgatctcattttttaggcttcctaatcccttgaagcacaatcgaaaaagccctggatctcttttctgcacatatcatcgcggaattcattcggcttccagcaagctgacactccatgatacaagcggcctcgcccttctccggacgccagtccttgctgcggttagctaggatgaggggtttgctgggcttcagtgcaggcttctgcgggttcccaagccgcaccaggtggcctcacaggctggatgtcaccattgcacactgagctcctggcaggctgtaccaattttttaattatttaatatttatttttaaaattatggtgaatattttggtattctgctctaaaataggcccataaatgcacagcagatatctcttggaacccacagctttccactggaagaactaagtatttttcttttaaagatgctactaagtctctgaaaagtccagatcctctacctctttccatcccaaactaagacttggaatttatgagagatctagctaacagaaatcccagacacatcattggttcttcccagagtgcagtcctcctaaagaggctcagccctaagcaggcccctgcaccaggagggtgggtctgagacccacatagcacttcccaaggtgcatgctccagagaggcactgaaacagctgagcacaagcctgcaagcctggagaactctcacagtcagaacggagggggcccagtgggactaacataaagagaaaagggaacacagagaaatggatggcaccaacaaccagcaaagccttcatggccaatgaaagcatcagtgacggggccagaaccctcatccccaaagactcttcactgcctttagtgaaaaacaatggctagagagtgaagttatgatcatgtatagagaggtaaagttacatttttatattctgactctgctaatgtgaaattccctatctgctagactaaaagtttcagacaccctgttcaaatatcccattagttgctagagacttaaaatgaacagaacgcacattgtcaggatgactattaccaaaaaatcaaaagacagcaagtattggtgaggatgtagagaaactggaacttttgtgcactgtttatgagaatgtaaaatggagcagctgctgtggaaaagagtatgcaggttcctcaaagagtaaaaccaagatgtggaaacaactaaatgcccatcagtggatgaaggggtagacaatatgtggtatatacataccatggagtactattcagcctctaaaaaaaaaaaaggaaattctataacatgcaacagcatggatgaatcttgaggacattttgctaatgaaataaggcagtcatagaaagacaaatactgcacgactccacttatatgagataccaaaaatagacaaattcatagaatcaaagagtacaatggaggttacctggagctgcagggcgggaaacgaggagttactaatcaacgaacataacgttgcagttaagtaagatgaataagctctcaagatcagctgtacaacactgtacctagagtcaacaataatgtattgtacacttaaaaatttgttaagggtagattaacaaatgtagtagatccacaaatgtggttaagtgttcttaccacagtaaaataaaaaaagaatatcaagcccaggagttcgagactagcctgggtaacatggtgaaaccctgtctctacagaaaatacaaaaattagccagctgtggaggtgcactcctagggaggctgaggtgggaggcttgcttgagcccaggaggtcaaggctgcagtgagccatgattgcaccactgtactccagcccagatgacagagcaagacaccaccccccccaaaaaaagaaaaagaatatcaaacattttaaaagatcagatacgcaagaacaacaacaaaaaagagatgaacagagcatcgaccctcatctagtgggattcttggtctaactgaaaaacagacattgagagacaaacaatgacagtgatgtgatcacagcaattacacaggtatcccctggggactgcagaagaaaggaggaatgcctaactttcagaaaatagagaaagcgtcaaacagttggtgaaagccttccaaaactagagagaactgcacacaccaaatcacagaaagaagaaaagccgtgggagattctgggacccaccggctatttttgatggctgaacaccctgctgcaggagagacaggagctggaaagcatggtgggatgaaacctcaaacagctttgcctgcattgcttaagatgactgggcttgattaactctagtcaatggggacaattcaatcaaagaagaaagatgctcaaattcacattttagaatgattttttatggcagtatggggaatagattaaaagagagtgaagctggaggcaagaaacttgttaagaggcaactgaaacagtctagatgataaataataaactgacagagtgactagaaaaatcagaacaggctgaatcaacagatacctagatgaaaataacaggacttgatcaccagttgtatcttggagaggaaggagttgtttccttgctttccctacgactgggaatacggaaggtttgccgtgtgtattggttatatactggtgtgtagccaatcactgacaaccatttagcagcttaaaacacaaaggcttatctcccagtttctgtgggccaggaatctaagataggcttagctggctggttctggctcagagtttctcaagaggttgcaatcaagatgtcagctggggttgcatcatctgaaggctcaactggggccggagggtccacttccaaggagttcactcacctgcctgacaaggcagtgctggttgttggcaggagatctcaattcattgccaagtgagcctctctatagcattgctggaacatcctccccatctggcagttggcttctctcagcatgagtgatctgagagagagagcaaggaggaagccacagtgttcttcctactcctactcctaacactatggacctactcctaacactctcacttctgccttattccattagttagaaagggaactaagctccacctcttgaaataagaagtgtcaaagaatttgtggatatatttaaaaatcatcacactgtggaagtggatagggggttcaattaatgctgaacttgaaatgcctgagacattcaaatgtccaacaggcaatgaacatacccatagatggtcatgactttagcaagaatagaggaagatcacagaattaaggaggaattgaaaggtaaaagaagtggagtcagattccccctgaaaagtgagccatgaaaggaactttaactattgagttagaggtcagagtaggaaatttcggtggaattcttttttaaagaaaggaaccatataagcatgttttgaggtagagggagaataaatcagtagacagggagaggtaaaaaacataaatgataggggatagttgacaaaggtcttggcagaatcccttacccattgacttggggccaagagagggacacttctttgtttgagggataaggaaaataagaaagaatgggtgctatttagtgtggtcctgtctctagggcaaacgcataggtaacaaactgtgtgtgttaggaatatagatgtgacctcacattgagattctcacctcaaatccattttgttgttacctgtaccttcctaccttctctttttgctacatgcagactgctgttttgtcttcctggcctgttccaggtttcagcattctggcatatctgctaccctgttcccaaacctctctagagtccatgctccttccttggatagtgtttgattgggccacgtatctaagaagtgatgccttcagttaggcctgagaacctcctctatggaaatctccatcagtgaccctgacagacttggtatcttggagatgtcactgctcccagcctgtggtctaggagaatctcagcctgggcctctagtagtatggataaggcgttaaggtatctttgaaccagagtctgtcatattcctcaatgtgggacagataaaacagtggtagtgctggtgtttctgagctagaactctggtttttggtctagattctttgatgtatgacctttcagaggtattaaaatttgttctaatacaatgttcaatacaaatgtagttccttttctgttaggacctcaacaaaacatgaccaactgtagatgaacattaaactatgacaattcatggaaatgaatacagtaatacctgcggttcccccattttagcagtcactatggtgacatttggcacaaatggctatttaagggtgcttttgttaaaacctaccatcttactaggcacatgatattgaaactaatgaaataatggagaaacttcttaaaaacttttaatgaataaagtgatgaagtgataatattttagctgctatttataaagtgactattacaggtcaaacattcttctagggtttttttgttgaagttgtcacatttaatccttaataacccactatgagtcaggtattcttctctcccctttggacagttggggaaatgggggtcagagaggttaggtaatttgctcagggccacacaacctgcatgtagaaaatctgagatttgtacaggaacgtatcaaactctgaagtccatgcttctattttcccatgctgcctttctaataaaaggtaactaatgctactggatgctgcccccaaagtgagtcactttcaccccaccctacttgattttctccataaaactaatcacatcctgacaacttatttattgctgatctcccccactagattataaactcaataaaagcaagatccttgtctgctgaatatcagtacctaaaacgctgtctagcacagagcaagtaattaatatttgttgaatgaacaaataaaggaaaaaaattcaaaggaagaaaaagccctaaaacagatgtttacctaaacatacattttaaaagaaagcatataacaaattcaggacagaatttaaatttgattttttaaagaaataaccaagtgctagctgggcacagtggctcacacctgtaatcctagcactctgggaggccgaggcaggcagatcacttgaggtcaagagttcaagaccagcctggccaacatggtgaaacctgtctctactaaaaatacagaaattatccaggcatggtggcaggtccctgtaaccccagctactcaggaggctgagtcaggagaattgcttgaacccaggaggcagaggttgcagtgggccaagattgcaccactgcactccagcctgagtaacaaagcaagactctgtctgaaggagaaggaaagaaagaaggaaagaaggaaagaaggaaagaaggaaagaaggaaagaaagaaagaaagaaagaaagaaagaaagaaagaaagaaagaaagaaagaaagaaagaaagaaagaaaaagaaagaaagaaagaaagaaccaagtgcttatttgggacctactatgctatgtttttccatgcacgctattttcagtaaagcagttagcaaacttgcaagatcataacaacaaatatatgcttctataactctaaaattgtgctttaagaagttcctctttaccagctcatgtatgcattagttttctaagagttactagtaactttttccctggagaatatccacagccagtttatttaaccaaaggaggatgcttactaacatgaagttatcaaatgtgagcctaagttgggccagttcatgttaatatactccagaacaaaaaccatcctactgtcctctgacaattttacctgaaaattcattttccacattaccaaggagccagggtaggagaatatagaaagaccacccaagaatccttacttctttcagcaaaatcaattcaaagtaggtaactaaacacatgccctaacaatgaatagcagattgtgctcagaagaatgatctacaacatcttactgtgaaggaactactgaaatattccaataagacttctctccaaaatgattttattgaatttgcattttaaaaaatattttaagcctaaattttaaaaggtttgatattggtacatgaatagacaaacagacatggactagaccaagaattaggttcaaacatatacaggaatttaatatacgataaatctagtattccaaaggaaccaacaaatggtgttcagacagcaggataggcatcaggaaaaacacagttgggcaccctaccttactcctaacaccaggagtaactgaaggagcaccaaatatttatttattttaattatagttttaagttctagggtacgtgtgcacaacatgcaggtttattacataggtatacatgtgccatgttggtgaggagcaccaaatatttaaaagaaaaaaattggccaggggcggtggctcacacctgtaatcccagcactttgggaggccaaggtgggcagatcacctgaggtcgggagttcgagaccagcctgagcaacatggagaaaccccatctctactaaaaatacaaaattagccaggcatggtggcacatgcctgtaatcccagctacttgggaggctgaggcaggagaatagctttaatctgggaggcacaggttgcggtgagctgagatattgcactccagcctgggcaacaagagcaaaacttcaactcaaaaaaattaataaataaataaaaataaagaaagaaaagaaaaaaatgaaaatagtataattagcagaagaaaacaccgtagaatcctcggactcttaggatggggaatgcctataatataaaaaccctgaagttataaaagagaaaatcacctacatacaaaccaaatctttctacatgcctaaaacatagcacaaacacagctaaataatcatagctgaatgaactgggaaaacaaaacttgactcatatccagacagagttaattttcctacacataaagagtacctatataaacccaacaaaaaaaccaccactaacccaaaataaaaatgtgacaggtaatgaacaggtagttcacagagaatacaaatggctcttcggcacataagatgctcagactgacttttacttatttattttttgagagacagggtctcacgatgttgcccaggttaggctcaaactcctgggctcaaatgatagtaccaggactacaggtgtgccccaccgcacctggctcctcaaccacctgtattaacaggaaatgcaaaataaaactttcaaatctattttacctattagaatggcaaaaatttgaaaaacttcaaacatcatcatgttggtgagaatgtgaggagactggcactctcattttttgctgatagcatatatatactgatggcttctatggaaagcaatctggcagcgtctatcaaatgtacaagtgcatatatcctttgacaaagcaattccactctaggaatgtgttctatatggttgtgcttcctggggctgggaactgggagctaagggacaggggcagaagataatcttcttttccctccttccccgttaaacatgttgaattttatatactgtaatatattatttttcacaaaagataatttttaagcgatatgtctgggaatttttttttttcttttctgagacagggtctcactctgtcatccaggctggaatgccatggtatgatctcagctgactgcagcctcgacctcctgggttcaagcaatcctcccacctcagcctcctgagtagctgggactacaggcacgtgccatcatgctaatttttgtatatacagggtctcactatgttgcccaggctaatgtcaaactcctaggctcaagcaatccacccacctcaggctccaaagtgctgggattacaggcgtgagccaccgcgcctggccctgggaattcttacaaaagaaaaaatatctactctccccttctattaaagtcaaaacagagaaggaaattcaacctataatgaaagtagagaagggcctcaaccctgagcaacaaacacaaaggctatttctgagacaggaatttgctgaacaaaatcgagggaagatgacaagaatcaagactcacttctcggctgggcgcagtggctcacacctgtaatcccagcactttgggaggccgaggcggacagatcacgaggtcaggagattgagaccatactggctaacacagtgaaacccagtctctactaaaaatacaaaaaattagccgggcgtggtggcaggtgcctgtagtcccagctacttgggaagctgaggcaggagaatggcgtgaacccaggaagcggagcttgcagtgagccgagatcacgccactgcactccagcctgggtgacagagcaagactctgtctcaaaaaaaaaaaaaaagactcatttctctagatcttgagccgtattcaaatttatctcagcttagtgagaggttaaagcaaggaatatccttccctgtgggccctgctccttactgaaggaaggtaacggatgagtcaaggacaccaatggagaaaagcactaacaccattatctgatgaacattacgtgaagaagggtaagaagtgaagtggaattgctgaagaagtcagtgaaagcggacattcatttggggaaatggaatataggaaatccataaaagtgattaaaaagatgttagaggctgaggcggggggaccacagggtcaggagatcgagaccatcctggctaacacggtgaaaccccatctctactaaaaatacaaaaaattagccaggcgtggtggcaggcacctgtagtcccaactactcgggagactgaggcaggagaatggcatgaacctgggagacggagcttgcagtgagccgagatcacgccactgcactccagcctgggtgacagagtgagactccatctcaaaaaaaaaagttagatacgagagataaagatccaacagacacacaactgctaattctgaacagaacaaaacaaatggcacaggaaaagaaaatttaagatataacaccggaaaactttcctgaaattgagtaactgaatctatagcttgaaagggtttagcatatgccaagaaaaatcagtagagtccaaccagcacaagacacatctagcaaggctggtgattctaccaacacagagaaagaagtgggtgacccataatgcggaaaaaggcagaccatctgcagtcttctccagaacactggagtctgaagacaaaagaatgctgcctactgagccagaagggagagaaagtgacccaacacatctttaccaagttagaatgtcacgcattatttaaaggctgcaaaagccatgaaagacatgaaagaacacaagcatttacaacatgaaagaacacaagcattctcatactcaagaatccttaagaaaaatgtagtcctaatccagcccactgaaagttaaatgtacttaatgtgctcattaatgggaacttcatagcttcaaatcagtctggtcccatctaccaacatctctcgcccggctttcctgcaatagtcagcacctttccctcctcccagtcttgtcccctggagtctgctctcagcatagcagagtgaccacatcaacacccaagtcagagccctccagtgcgcactggtctacaaagcccttcccaccccccaccccacgtgccctccggatccttgtgacgtgtctcctgcataccctagcagccctggcctcctcactgcccctcctgtacatcaggaaggcgactccttgagtcttggctctggccgcctcctccacctgcagtgagttaactcccttacctactctaggtcattgctcaaatgtcagcatctcaatggggccctccctgactaccctatttaaattctacatactccccttgaccccatggacctcactcaccctattccacttttattcttacaatttagcacttgttctcttctaacgtattctaagacttactcatttattacattgtttgccaccccctctagtacataaactccagaggggcagggatttctgtctatttattcatttctttatccctaggacatagaacagggcatagttcagagtattcaatgttatcaatgaatgaactagcagtagtaccagttccagttaggcacagaattaaatctaaatagaattaaatctcatggtctgggttaactatggatagaaaattagatataattttaagaagcctagaaagaaaaaattaataatgtaaaaataatattaatttgataataataacaaaaactctgccaggcactgtggctcaaatctgcaatcccagctactcaggaggctgaggtggaaggatcacttgagaccagagttcaagactcagcctaggcaacacggcaagaaactgtctctaaaaaaattaaaacttaaatttttaaaaaagaattctcaaagcgtcacaaaaactggagattaaggtacaggaagtgtgaagtaatattactatgctaatggttttttttttttttagaaaggtataaccaaaagatttctttctcaagtcgataaactgagaaagataagcatatcttccaattaacagagggggaggaaaagccagatacaacaaaataagatataaattagtttccagttgaaaacaagagtaggagttattttgcatcacctcacctgtgacctcccccagcccaaaaaacactactgataaacagggtagaaaagcatcatctcagataaagcaggaaaaactgccacagtctcaaaccacaaactataagcacacacctggccaaccctgccaagtctgggctcagtaggaggaacgtgctgagagctaggatgtaccaacttagacattctgtgggatacagatgtccctggaagggtcacaccatctcaaaggcacctgtaatgcccactgattacagccaccatatgtgagagagaaactcagggcacttagagagtataacaagaaccttatgtcatctgagatgaggaatcctcagccctgcaaattaaccaactctttagaacaactggcaaaacataaatatccacaacttttgtttcagtaattccactcttagatatcaatccaaagtacatgagacagcagatacacacacaaaatggtatttactgcagcattgtttataatagcaaaaaacaagaaataatccatatgtctcaataggatactgggtacatgagggtatgtacccatcattcaaccatcaaaaagagtgatatggatgtccacagatggacataaaaagctgtgtgttacgtgaaaacaaactcaagcagcagcaggatgggcttatgatagtcagtatgagctaatttctggaaaaaaaaatctagtgtgtgcacagaaaacatctgaaagaacagaaacaaaactatcagcagaatattgagatgttttactaagttgtatatctatactgcttgtaatttttaccccaagcaagaattactttttggaaaaagaaaattcaggaaataaagcatttctttaaacttcatgtttaaacaaatggtgatggaataaaagagttcttattcatcataaacacacacagcacacatgcacgcatgtgcgtgagcacaccctttacttgataaataccatgttgaatattttagtctttccttttaggttctatcccttcactcaaaatgcggttataaataaatgtacttttcatgtgccttctgcctaaacccactttaatataactttacagtcccattatcattatagtctcaaagctagactcagcctgaaactaccctttcatttggaacccttattaaaatgccacatacagctccttcaaataaaaacaaaccctaggacctgacactaggcttcctttgttgctactcataatggccaagttctgtgcttataatacatcttctttcattttattgctacatatccaagggttttatatgtttttcttattatatcttaattcaaaacaccatcacgctcttttccagatgaaaataaggaaaagaaattgagcaactgactgacttaaaggtcataaaactatatagtagcagagtcagcaaaagaagaaacacacatctcccaagtagaggctgaaaaccagtaccattcacctccagggtgagctatatacagattacaaagtcaccttctctaaatgttcaaactgaatcccatacccatactttaccactacctcgtaagaacagcctcagatcttgttatagccttttttttagcatgctgaagccaataaaatgcttcccattcagcaagagaaacaagttctgaaacactgaataatctgcccagggcctatgaacatttccactgtgagaaatgttctccactgtgtggagaagatccttactcttctccacacaggcagaacattagaaaaattcttggattctatgatgcacagcttaggagtctgtttagcacaatttaagtccaaatagttattaaatcctcctctgttccagaaacagtgctaaatactgtgaatataaaaattgaaaagatactctcctggctcccaagaaagtcagccagatagaggagacacaggcacacaaatcactgtcacatgaagctctacctccctaacttcaaacgagggcctaagtcaccaagaatacagtagcagttgtgactacgagtaactactataattcaatactttatcttcccttagaaaactcttctcccttggaaatttatttgcatttctaaataccattccttactaaaaggaagcagggctccttggggaaatagctgattctaggtgtggactatgaaatgaaaatggtgagtctgggacatcccatgttgcccagaaatcaaggaactgcccaaagattaacagagtcatgttaaatggacctaagagtgaaccagaaggagctcactttgccccgcgtggaacaatttcaagaaaaacatgacagtaatgaattataaaacatgaattaaaatacatattggtactaaaaagagaacaaaaggatgtggctttggataaagctcttcttcatggaagaataccagctaataaatgtaaaggaaatgagagaattagaaaaattatcattttgtaaaccttaatatattcacctagacatgctaaaaccactgagtaaaaggctgcttgggaagaggatgctcacatgatctcagagtttcacaccacagataatttattagatacaggaaggaagatgtgatcaagcttcctgtgacccccagccaggccccacaacactatgtgcctccttgtgatgtgggagctacacagcatcgcccacacagcttctcgccaaaactgtttgaagctaatcacaagggaagaactggacagcttctgaccatgagacgctccaccagacaacttgcttggcctctccaaagaaacttgcttggcctctccaaagaaaactcagtttcatttaaaaacaaaactaattatttaaaaacaaacgaaaagcaagttgtggacttgagctccagggacagagcagacatacttttccctgttcttcccagtaagtggtaataaaaaccctcaacactagatataaaacaaatataagaaggttctggaaggggaagaggaggcagactatccaggtgccttgaggcccacagaacaacccagtgatgggttcactgggtcttctttttgcttcattatctcagacttggagctgaagcagcaggcaacttcaaaacaccaaggggcacagattgaaaagccccaagaaaagcctgccctctctagccaaaggaccaggaaggagacagtctaatgagatggaacacatttagacagtaactgcccatttaccagcaataactgagcagggagcctagacttccagtcttgtgaggacgtaccaaggtacccaacacccccaccaaggctgagtaaggactgcgacttttatccctgcatggcagtagtaaggagcccatccctcacccgccagcagtgtcaggggaacctggacttccactcccacccaggagtgatgaggccctccctgctggggtcatgtcagaggaggcctagtggagattcagtgacttaaccttttcccagagataatgaggccacctttcctccctcttcccccatggtgacagtgaaagcactgtggcaagcagtaggcactcctacccctcctagccagggaggtatcagggaggccaagtagggaaccagaatacccacaaccacccagcagcaacaggggtcccccaccccattgggtgtcaatggaagcagagcggaaagcctggatatttacccccatctagaagtaacaagctgatgtcccccttcttctactacaatggtgttcaaaacaggtttaaataaggtctagagtctgataacgtaatacccaaatcgttgaagttttcattgaggatcatttataccaagagtcaggaagatcccaaactgaaagagagaaaagacaattgacagacactagcactaagagagcacagatattagaactacctgaaaggatgttaaagcacatatcataagcctcaacaggctgggcgcggtggctcacgcctgtaaccccagcactttgggaggccgaggcaggtggatcacaagatcaggagatcgagaccatcctggctaacacggtgaaaccccgtctctactaaaaatacaaaaaaaaatagcaaggcatggtggtgggcacctgtagtcccagctactcgggagcctgaggcaggagaatggcatgaacctgggaagaggagcagtgagccgagatcgcaccaccgcactccagcctgggcaacagagcaagacttcgtcccaaaaaaaaaaaaaaaaaaaaaaaaagcctcaacaaacaactacaaacgtgcttgaaacaaatgaaaaaaaaatcttggcaaagaaataaaagatatatattttggccaggtgcagtggctcacagcctgtaatccctgcactttgggaggctgaggcaggcggatcacctgaggtcaggagtttgagaccagcctgaccaacatggagaaaccccgtctctactaaaaatacaaaattagccagtcatggtggcacatgcctgtaatcctagctactcaggaggccgaggcaggagaatcgcttgaactcaggaggtggaggttgcggtgagccgagatcccgccattgcacattgcactccagcctgggcaacaagagcaaaactccatctcaaaaaaatagatacatattttaatggaaattttagaattgaaaaatacagtaaccaaattgaatggaaagacaacatagaatggagggggcagacaaaataatcagtgaacttcaacagaaaataatagaaattacccaatatgaagaacagaaagaaaatagactggccaaaaaataaagaagaaaaaagaggagcagcaggaggaatgatggaaaaagagaaaggaaggaaggaagggaaggagggagggaaggagtgagggagaaagtctcaaagacctctgagactaaaataaaagatctaacacttgtcatcagggtccaggaaagagacaaagatggcacagctggaaacgtattcaaaaaataatagctgaaaacttcccaaatttggcaagagacataaacctatagattcgaaatgctgaaccccaaataaaaagcccaataaaatccacaccaaaatacatcatagtcaaacttctgaaaagacgaaaagagaaaacgtcttgaaagcagtgagtgaaacaacacttcatgtataagggaaaaacaattcaagtaacagatttcttacagaaattaaggaagccagaaggaaatgacacaatggttttcaagtgctgaaagaaaagaagtgtcaacacaaaattctagattcagtaaaaatatccttcaagaatcaatgggaaatcaagacagtctcagataaagcaaaataagagaatatgttgccagcagatctcccctaaaggaatggcaaaaggaagatcatgcaacagaccaaaaaatgatgaaagaaggaatccagaaacatcaagaagaaagaaataacatagtaagcaaaaatacatgtaattacaataaaatttctatctcctcttaagacttctaaattatattgatggttgaagcaaaaattataaccctgtctgaagtgcttctactaaatgtatgcagagaattataaatggggaaagtataggtttctatacctcattgaagtggtaaaatgacaacactgtgaaaagttacatacacacacacacgtaagtatatataaatatatgtgtgtatatgtgtgtgtatatatatatatacatataatgtaatacagcaaccactaacaacactatacaaagagataataaccaaaaacaatttagataaattgaaatggaattctaaaaaatattcaaatactctacaggaagacaagacaaaaagagaaaaaaagaggaggacaaactaaattttttaaaaacataaataaaatggtagacttaagccctaacttatcaataattacataaatgtaaatgatctaattatatcaattaaaagacagagatagcagagttaatttaaaaacatagctataagaaacctgctttgggctgagtgcagtgactcacacttgtaatcccagcacttcgggaggccaaggcgggtggatcacctgaggtcaggagttccagaccagcctggacaacatggtaataccccatctctactaaaaatacaaaaaaattagccaggcatggtggcacacgcctgtagtcccaactactcaggaggctgcgacacaagaactgcttgaacccgggcagcagaggtagcagtgggccaagattgcgccactccagcctgaacgacagagtgagactccacctcagttgaaaaacaaaaaagaaacctgctttaaatataccaacatatgttggttgaaattaaaagaataaaatatatcatgaaaacattaatcaaaagaaaggagtggctatattaataacataaaatagacttcagagaaaagaaaatttcaagagacaggaataaaaggatcaagaaaagatcctgaaagaaaagcaggcaaatcaatcattctgcttggagattcaacaccctctcttaacaactgatagaacaactagacaaaaaaatcagcatggagttgagaagaacttaacaccactgaacaacaggatctaatagacatttacggaacactctacccaacaatagcaaaataaacattcttttcaagtattcactgaacatatccttagaccctaccctgggccataaaacaaagctcactagtgattgccgaaggcttggatggacagtggaagagctgcatggggagggagaaggtgacagttaaagagtgtaggatttctttttgggataatgaaaatgttccaaaattgattgtggtgatgttggcgcaactctacaaatataaaaaaggccattgaattgtacgttttaagtgggtgaaacatatggtatgtggattatatctaacgctttttaaaaacttaacacatttcaaagaatagaagtcatacagagtgtgctctactggaatcaaactagaaagaggtaactggaggataacgagaaaagcctccaaatacttgaaaactggacagcacatttctaaaatcatccgtgggtcaaagatattcatttctgatattcatttttattgtttaatgtatttttaaaaatttcttaagggaaataaactgactaaaaatgaatatggctgggtgcggtggctcacgcctgtgatcccagcactttgggaggccgaggctggtggatcacaagatcaggagttcgagaccagcctggccaagatggtgaaaccccgtctcaactaaaaaactacaaaaagtagccaagcgcagtggcgggagcctgtggtcccagctacttgggaggctgaggtaggagaatcgcttgaacacaggcagcagaggttgcagtgagccaagattgtgccactgcacgccagcctgggcgacagagactgcctcaaaaaaaaaaaaaaaaaaaagaatatcaaaatttgtgggacatagttaaagcaatgctgagagggaaatttataacactaaatgtttacattagaaaagagaaaaagtttcaaatcaatagtctccactcccatctcaagaacacagaagatgaagagcaaaataaacccaaagcaagcaaaagaaagaaaatataaaaataaatcagtaaaattgaaaacagaaacacaataaagaaaatcagtgaaacaaagtactgattcttcgaaagattaataaaattgacaaacctctagcaaggctaacaaacaaaaaagaaagaagacacggattaccagttattagaatgaaagcataattagaaacaactctacacattataaatttgacaatgtagatgaaatggactaattactgaaaaaacacaaattaccacaactcacccaatatgaaatagataattgggatagcctgataactactgagaaaattgaatttgtaattttaacactcttaaaacagaaacattaaacttaatattttataaatattagataaggtaattatacccttccttaacaaataaaaacgacaaattattttgcagctaaagagatgtatgtactgtgaaaaatatcttcagaaaaatagaactttgtttgaagaataaggatttaaaaaatgtttttaactctcaagaagcaaatatctgggcccagatggtttcactgaagaattctaccaaatgtttaatgaagaattaccaccaactctacatagcatctttgagaaaactgaagagaagggaacatctcccagttcattttatgaagtgggtgttactctgatactagaactgtataaggacagctactcttgacacactgcctatgggtagctctgctctgcaggaacagtcagaaaaaaaaaaaaaagaagcactggacaagggcagtataaaaaaagaaaactgggccaggtgcagtggctcacacctgtaatctcagcactttgggaggctgacgctggtggatcacctgaggtcaggagtttgagactagcctggccaacatggtaaaaccctgtctctactaaaatacaaaaattagccaggcagggtggtggggaaaataaaaaggaaaaaaaaacaaaaataaactgcagaccaatatccttcatgagtatagacacaaaactccttaaactccttaacaaaatattagcaagtagaagcaatatataaaaataattatacaccatgatcaagtgggacttattccagaaacgcaagtctggttcaacatttgaaaacaaggtaacccactatatgaacgtactaaagaggaaaactacataatcacatcaatcaatgcagaaaaaagcatttgccaaaatccaatatccattcatgatactctaataagaaaaataagaataaaggggaaattccttgacttgataaagcttacaaaagactacaaaagcttacagctaacctatacttaatggtgaaaaactaaatgctttcccctacgatcaggaacaaagcaaggatgttcactctcattgctcttatttaacatagccctgaagttctaacttgtgcaaaacgataagaaagggaaatgaaagacctgcagattggcaaagaagaaataaaactgttcctgtttgcagatgacatgattgtctcatagaaaatgtaaagcaactaggggtaggggggcagtggagacacgctggtcaaaggataccaaatttcagttaggaggagtaagttcaagatacctattgcacaacatggtaactatacttaatatattgtattcttgaaaatactaaaagagtgggtgttaagcgttctcaccacaaaaatgataactatgtgaagtaatgcatacgttaattagcacaacgtatattactccaaaacatcatgttgtacatgataaatacacacaattttatctgtcagtttaaaaacacatgattttggccaggcacagtggctcatacctgtaatcccagcattttaggaggctgaggcgagcagaaaacttgaggtcgggagtttgagaccagaatggtcaacatagtgaaatcccgtctccactaataatacaaaaattagcaggatgtggtggcgtgcacctgtagacccagctacttgggaggctgaggcacgagaattgcttgaacaagggaggcagaggttgcagtgagctgggtgccactgcattccagcctggtgacagagtgagactccatctcaaaaaaaataaaataaagcatgacttttcttaaatgcaaagcagccaagcgcagtggctcatgcctgtaatcccaccactttgggaggccgaggcaggcagatcacaaggtcaggagtttgagaccagcctgaccaacatggtgaaaccccatctctactaaaaaatatataaattagccaggcatgtgtagtctcagctactcaggaggctgaggcaggagaatcacttgaacccggaggcagaggttgcagtgttgagccaccgcactccagcctgggtgagagaacgagactccgtctcaaaaaaaaaaagcaaaataacctaattttaaaaacactaaaactactaagtgaattcagtaagtctttaggattcaggatatatgatgaacatacaaaaatcaattgagctggacaaaggaggattgttttaggtcagtagtttgaggctgtaatgcacaatgattgtgcctgtgaatagctgctgtgctccagcctgagcagcataatgagaccacatctctatttaaaaaaaaaaaaattgtatctctatgtactagcaataagcacatgggtactaaaattaaaaacataataaatactgtttttaattgcctgaaaaaaatgaaatacttacatataaatctaacaaaatgtgcaggacttgtgtgctgaaaactacaaaacgctgataaaagaaatcaaagaagacttaaatagcgtgaaatataccatgcttataggttggaaaacttaatatagtaaagatgccaattttatccaaattattacacaggataacattattactaccaaaatcccagaaaaattttacatagatatagacaagatcatacaaaaatgtatacggaaatatgcaaaggaactagagtagctaaaacaaatttgaaaaagaaaaataaagtgggaagaatcagtctatccagtttcaagacttacatagctacagtaatcaagactgtgatattgacagagggacagctatagatcaatgcaaccaaatagagaactaagaaagaagcacacacaaatatgcccaaatgatttctgacaaaggtgttaaaacacttcaacgggggaagatatgtctctcattaaagggtgtagagtcattgcacatctataggcaaaaagatgaacctgaacctcacaccctacagaaaaattaactcaaaatgactcaaggactaaacataagatatacatctataaaacatttagaaaaaggccacgcacggtggctcacgctcgtaatcccagcactttgggaggccaaggcaggtggatcacctaaggtcaggagtttgagaccagccggatcaacatggagaagccccatctctactaaaaatacaaaattagctggacgtggtggcacatgcctgtaatcccagctacttgggaggctgaggcatgagaatcgcttgaacccggggggcagaggttgcggtgagccaagatcacaccattgcactccagcctgggcaacaagagcaaaactccaactcaaaaaaaaaaaaaaaaaggaaaaatagaaaatctttgggatgtaaggcgaggtaaagaattcttacacttgatgccaaactaagatctataaggccagtcgtggtggctcatgcctgtaattccagcactttggtcaactagatgaaaggtatatgggaattcactgtattattctttcaacttttctgtaggtttgacatttttttagtaaaaaattgggggaaagacctgacgcagtggctcacacctgtaatcccagcactttgggaggccggggcaggtggatcacacggtcaggagttcgagaccagcctggccaacatggtgaaaccccgtctctaccaaaaatataaaaaattagccgggtgtcatggtgcatgcctgtaatcccagctactgaggaggctgaggcaggagaatcacttgaacctgggaggtggaagttgcagtgagccgagattgtgccactgcactccagccttgggtgacagagcgagactccgtctcaaaagaaaaaaaaaaaaaagaatatcaaacgcttactttagaaactatttaaaggagccagaatttaattgtattagtatttagagcaatttttatgctccatggcattgttaaatagagcaaccagctaacaattagtggagttcaacagctgttaaatttgctaactgtttaggaagagagccctatcaatatcactgtcatttgaggctgacaataagcacacccaaagctgtacctccttgaggagcaacataaggggtttaaccctgttagggtgttaatggtttggatatggtttgtttggccccaccgagtctcatgttgaaatttgttccccagtactggaggtggggccttattggaaggtgtctgagtcatgggggtggcatatccctcctgaatggtttggtgccattcttgcaggaatgagtgagttcttactcttagttcccacaacaactggttattaaaaacagcctggcactttcccccatctctcgcttcctctctcaccatgtgatctcactggttccccttccctttatgcaatgagtggaagcagcctgaagccctcgccagaagcagatagtgatgccatgcttcttgtacagcctacaaaaccatgagcccaataaaccttttttctttataaattatccagcctcaggtattcctttatagcaagacaaatgaaccaagacagggggaaatcaacttcattaaaataatctatgcagtcactaaacaaataagaacaagaggctccagaagtgggaagccaatacccagagttcctacaatacagtatctgaaaagtccagtttccaaccaaaaaatatatatatacaggccggacatggtagcttatgtctgtaatcccagcactttgggatgctgaggcgggcagatcaccctaggtcaggagttcgagaccagcctggccaatatggcaaaaccccgtctctactaaaaatacaaaaattagccaggcatggtggtggatgcctgtaatcccagctactcgggaggctgaggcagggaatcacttgaacccaggaggcagaggttgcagtgagccgagatcacgccactgaactccagcctgggcaacaaagtgagactccacctcaaaaaaaaaaaaaatatacatatatatatgtgtgtgtgtgtgtgtgcgcgcgtgtgtgtatatacacatacacatatatacatatatacagacacacatatatatatgaagcatgaaaagaaacaaggaagtatgaaccatactttctgtggttatgataggatggggtatcacgggggaagtagacaagggaaactgcaagtgagagcaaacagttatcagatttaacagaaaaagactttggagtaaccattataaatatgtccacagaattaaagaaaagcgtgattaaaaaaggaaaggaaagtatcataacaatattactccaaatagagaatatcaataaaggcatagaaattataaaatataatacaatggaaattccggagttgaaaggtagaataactaaaatttaaaattcactagagaaggttcaacactatatttgaactggcagaagaaaaatttagtgagacaaatatacttcaatagacattattcaaatgaaaaataaaaagaaaaaagaatgaagaaaaataaacagaatctcagcaaaatgtggcacaccattaatcacattaacatatgcatactgagagtaccggaagcagatgagaaagaggaagaaaaaatattcaaatgatggccagtaacttcctagatttttgttttaaagcaataacctatacaatcaagaaactcaatgaattccaagtaggataaatacaaaaagaaccacaaacagatacaccatggtaaaaatgctgtaagtcaaaaacagagaaaatattgaaagcagctagaggaaaacttataagagaacctcacttacaaaagaacatcacttataaaagaaccacaataatagaaacagttgacctctcatcagaaacaatgaatgataacatatttgaagtgctcaaagaaaaaaaataaagattcctatatacgacaaagctgtctttcaaaaatatacatccaaaaggattgaaaccagggtcttgaagagttatttgtacatccatgttcatagcagcattattcacaatagccaaaaggtagaagcaacccaagggtccatcgacaaataaataaaatgtggtatatgtatacacaatggaatttattcagtattaaaaaggaatgaaattctgacacatgctacaacatggctaaaccttgagaacactatgctaagtgaaataagccagccacaaaaggacaaataccatattacttcacttgtatgaaatacctagggtagtcaaattcagagatagaaagtaaaacagtggttgccaagggctgagggagggagtaacgtggagttattgttgaatgggtacagaatttcagttttgcaagataaaaagagttctggagacagatggtggtgagggtggtacaacaatacaaatatactttatactactgaacagtatacttaaaaatgattaacatggtgaaaccccgtctctactaaaaatacaaaaaaattagctgggtgtggtggcgggcacctgtaatcccagctacttgggaggctgaggcagcagaattgcttgaaaccagaaggcggaggttgcagtgagctgagattgcgccaccgcactctagcctgggcaataagagcaaaactccgtctcaaaaaataaaaaataaaaaaaatttaaaaatgattaagcaggaggccaggcacggtggctcacacctataatgccagcactttgggaggccgaggcaggcgatcacttgagaccaggagtttgagaccagcctggccaacatggcaaaaccctgtctctgctaaaaatacaaaaattagccaggcatggtggcatatacttataatcccagctactggtgagactgagacacgagaattgcttgaacccaggaggcagagattgcagtgagtcgagatcgcgccactgaattccagcctgggcgacagagcaagattctgtctcgaaaaaacaaaaacaaaaacaaaaagcaaaaccaaaaaataattaagcaggaaacgagattgctgctgaggaggagaaagatgtgcaggaccaaggctcatgagagcacaaaacttttcaaaaaatgtttaatgattaaaatggtaaattttatatgtatcttaccacaaaaaaaagggctggggggcaggaaatgaaggtgaaataaagacatcccagagaaacaaaagtagagaatttgttgccttagaagaaacaccacaggaagttcttcaggctgaaaacaagtgaccccagagggtaatctgaattctcacagaaaattgaagcatagcagtaaaggttattctgtaactatgacactaacaatgcatattttttcctttcttctctgaaatgatttaaaaagcaattgcataaaatattatatataaagcctattgttgaacctataacatatatagaaatatacttgtaatatatttgcaaataactgcacaaaagagagttggaacaaagctgttactaggctaaagaaattactacagatagtaaagtaatataacagggaacttaaaaataaaattttaaaaaatttaaaaataataattacaacaataatatggttgggtttgtaatattaatagacataatacaaaaataccacaaaaagggaagaagacaatagaactacataggaataacattttggtatctaactagaattaaattataaatatgaagtatattctggtaagttaagacacacatgttaaaccctagatactaaaaagtaactcacataaatacagtaaaaaaataaataaaataattaaaatgtttgtattagtttcctcagggtacagtaacaaactaccacaaattgagtggcttaacacaacttaaatgtattttctcccagttctggaggctaaacacctgcaatcaaggtgagtacagggccatgctccctgtgaaggctctaggaaagaatcctcccttgtctcttccagcttccagtggttctcagtaaccctaagtgctccttggcttgtagctatatcattcctagcaaccagaaagaagaaaataataaagattatggcaaaaaataatgaaatcaaaaggagaaaaatggaaaaaaataaataaaaccaaaagctagttctttgaaaagatcaaccaagttaacaaaccttttaactagactgacaaaaaggaggtaagactcaaattactagaatcagaaataaaagaggggacattactaatgagggattagaaaagaatactacgaacaaatgtgtgccaacaaattagaaaacttagatgaaatggacaggttcctaggacaacatcaactaccaaaatttactcaagaagaaagagacaatttgaatgagctataacaagggaagagactgaattgacaaccaagaaactatccacaaagaaaatcccaggcccagaagatttcactgtgaaattctttcaaacttataaatataaattaacatcagttcttcacaaactcctccaaaaaaaagaacagatctctatttacaggcgatacgatctttagaaaatcctaagggaactactaagacactatgataactgataaacaagttcagcaaggctgcaggatagaaaaccaatatacaaaaatctattatatttctatacacttgcagtgaacaacccaaaaatgagattaagaaaataattcaatttacaataacatcaaaaagaataaaaacactcaaaaataaatttattcaagtaagtgcaaaacttatactctagaagctacaaaacactgttaaaagaaattaaaggtttacataaatgaaaaactatcccatgttcatggatcaaaagacttattactggcaatgctctccaaattgatctataaattcaacaaaatccttatcaaaatcccagatgaggctgggggtggcggttcatgcctgtaatcccagcactttgggaggctgaggcacgcagattacctgaggtcgggagctcgagatcagcctgaccaacatggagaaaccctatctcttctaaaaatacaaaattagtcaggcgtggtggcacatgcctataatcccagctactcgggaagctgaggcaggagaatcgcttgaacccaggaggcagaggttgcagtgagccaagatcgtgccattgcactccagcctgggcaacaagagcaaaattccatctcaaaaaaaaaaaaaaaaaaatcccagatgacttcactgttgaaattgaaaagattattctaaaattcacatggaattgcaagaccttgagaatagccaaaacaaacttgaaaaacacgaacaaaatataggatgactcacttgccaattgcaaatgttacgacacagcaacagtaatcaagactgtgtggtactggcaaaagacacatacatacatacatatcaatggaatataattgagagtacagaaacaagcctaaacatctatggtaagtgcttttctatttttttctttttttttttcttttttgtagagatagaatctcaccatgttgcccaggctggtcttcaacttctgggctcaagcaatcctcccactgtggcctcccaaagtgctgggataactggcatgagccaccacatccagcccagatgattttcaaaaaagtcaacaagaccattcttttcaacaaataggtctgggatgatcagatagtcacatgaaaaaaaaaatgaagttggaccctccatcacactaaagtgctgcgattataggcatcagccaccacatccagcccaaatgattttcaaaaaggtcaacaagaccattcttttcaacaaataggtctgggataatcagatagtcacatgaaaaaaaaaatgaagttggaccctccatcacaccatatgcaaaaattaattcaaaaatgaattgatgacttaaacgtaagagttacgactgtaaaactcttagaaggaaacatacgggtaaatcttaaagacgttaggtttgacaaagaattcttagacatgacaccaaaagcatgaccaactaaggtaaaatagggtaaattgtacctaccaaaatgaaaaacctttgtgctggaaaggacaccatcaagaaatggaaagccaaaatagccaaggcaatattaagcaaaaagaacaaagctggaggcatcatactacctgacttcaaagcaacagtaaccaaaacagcatggtactagtagaaaaacagacacatagaccaatggaacagaataaagaacccaaaaataaatccacatatttatagtcaactgatttttgacaatgacaccccttcaataaatgatactaggaaaactggatatcgatatgcagaagaataaaactagacccctatctctcaccatatagaaaaatcaactcagactgaattaaagacttgaatgtaagacccaaaactataaaactactggtagaaaacataaggaaaaacgcttcaggacattggtccaggcaaagatcttatggctaaaacctcaaaaacacaggcaacaaaaacaaaaatggaaaaatagcactttattaaactaaaaagctcctgcacagcaaaggaaacaacagaatgaaaagacaacctgtagaatgggagaaaatatttgcaaactatccatccatcaagggactagtatccagaacacacaagtgactaaaacaactcaacagcaaaaaagcaaataatctggtttttatatgggcaaaagatctgaataaacattctcaaaggaagacatacaaatgtcactatcattctgccagtaccacactgtcttgattacttgttagtgtataaatttttaaattgggaagtgtgagtcatcctacactttgttcttgtttttcaagtttgttttggctattctgggagccttgcaagtataaaatagccaacaagtatgaaaaaatgctcaccatcactaatcatcagagaaataaaaatcaagaccactatgagatatcctctcactccagttagaatggctactatcaaaaagacaaaatataatggatgctggcaaagatttggagaaaggggaactcctatacactgtgggtagggatgcaaattggtaatggccattatggaaaataatactgaggtttttcaaaaaactgaaaatagaactaccatatgatccagcaaccctactactgggtatttatccaaaggaaagaagtcagtatactgaagaaatatatgcactctcatgttaattgcaacactgttcacaacagccaagacagggaataaatctaaatgtgcatcaacagatgaatggataaagaaaatgtggcatatacactcaatagaatactattcagccattaaagaagaatgaaatcctgtcatcccagcaacatggatgaacctggaggacattatatttaatgaaataagtaaagcacaaaaagataaacagtacatgttctcactcagacatgggtgctaaaaagaaaatggggtcacagaattagaaggggaggcttgggaaaagttaatggataaaaatttacagctatgtaagaagaataagttttagtgttctatagaactgtagggcgagtatagttaccaataacttattgtacatgttcaaaaagctagaagagattttggatgttcccagcacaaaggaatgataaatgtttgtgatgatggatatcctaattaccctgattcaatcattacacattgcatacatgtatcaaattatcactctgtacctcataaatatgtataattattacgtcaacaaaaaaaggaaaaaaaagaaaattaagacaacccacataatggaagaaataaaatatctgcaaattatatatatctgataaatatttaatatttataatatataaagaactcctacaactcaagaacaacaacaaaacaacccaattcaaaaatgggtaaaagccttgaatatacacttatctaaagactatatacaattggccaataaagacacgaaaagatgctcaacatcactagtcatcagggaaatataaatcaaaaccacaatgtagaatgtagacaccacttcatatgcactaggatggctagaataaaaaggtaataacaaatgttggtaaggatgtgaaaaaatcagaaacctcattcgctgctgttgggaatgtaaagtgatgcagccactttggaaaacagtctggcagctcctcaaattattaaatacagagttaccgtatgacccaggaatattcctcctgggtctataaccaaaaaaatgaaaacatatatccacataaaaacttgtacatgggcatttatagcaacattattcataacagcaaaggtggtaagaacccatatgcccatcatctgatgaacaggtaaataacatgcggtattatccatacactagaatattatctgcccatacaaggagtgacatccagctacatgctacaaggatgaatctcggaaaccttatgctaagtgaaagaagccagtcacaaatgaccacagattatgattccatgcatcggaaatgaccagaatagggaaatctatagagacagaaagtagattagtggttgggtggggctgggaggacaggtagtacactactttcccagaactactggaacaaagtaccacaaactggggagcttaaacatagaaattgatttcctcacagttctggagactaggactctgagatcaaggtgtcagcagagctggttctttctgagggccctgaggcaaggctctgtcccaggcctctctccttggctggcaggtggccatcttctccctgcgtcttcacatcatcttttctctgtgtgtgcccatgtccaaattttgattggctcattctgggtcatggccaattgctatgcacaaagtgaagtctacttccaaaagaagggaagagggaacactgactaggctaaacttatagtcattttaatgtccgcttttcctatgagattgtgaacacacagaagtagggtttttatctacattgtgcaaagtttaataagaaaaatagaattcaagagaagcagttcaatagcaggaatttaatatgggaactaattacaaggtttagggcaggactaaaaagccagttgggatggtgagccaacccagagattagcaacagtgggaccccatctacctaccacccatgaagctggaaggataaaggaggggctattatcagagtccacaagccagtgtcagagtccttggctggagctgggaccaccctagagacactgtgcaaagcagaaaacaagggggaaaaaccctgacttctcccttcctcccacctttcaatctcccactagtgcttcctactagccatacttggccagagacagtgacaaggaacactgcaaaatgaagtttgtaggaatcatctccctctgagacagagaaatatggaagggtagaaaatgaatcagaggataaagagaaaaaaccctgagtactatcttatttatctttgtatctccagtgcctaatctgtctctcaaaaaaggaaagcaattgagagaaactgaaaactccaattgaaatgaaagaatggagaattactggactagaagagaagagaaaaatttattccgcatagagtaaacaagaatggattcacaaaggacgtgatgaatgaaaagctataatcagcaaagatttgccagagaaattaaaaagtggtaaactcagccacgctgtacaacctgaaggcacaatgcatgaaaacgtttcaagaaatgacaagatttgaagtcaaattctaagtgcttttccagaatctctcaagacgattatatagctaccccattttattaaataaaatggaaacttactaaactttccccttgtattaaactaacatatgtcctaatagcaaacgattctggaattcctagagtaaaatatatttcgtcaaagtgtattgctcttttaatattctgctgacctccttttgctatttaggatatttgtatacacatcacacgtaaatttggtctatagtttacatctacgggcttatactgttctttttttcatttttttaaaatttccaacccccagtatccatatactgctctctatcagggttattttaactttgtaaaatcagctgagatgctttccatgttttttttttttattttctgccacatttgaatagcataggagttaccaccatcaaccttggattatttaagcattcacgattccacgtgtggattttttattcagagtctttcttgtcattcctgctatcagcacagaacccaatctcagctttccagctatactctcaccccatggaatttgcagatgaagttcaaaaggacctttgcattatcctgcctcgccctcttcccccttcatttagacatcaccttcttctagaacgtcttacctgacatgccctgctcccaacccctgctgcccaattgtgtgctctcccgtgtcctggcctgccatcctctttagtaattgcctgctccctcatctgtctccccacccagacattaagctgaatagactggatttgtgtcttgtccatcactataatctcagcacctagtacctagtaggtacttaccatgtattcattagcaaaatgttatgtataaccttgcaccttaaaaacaagagaaggaagacaaaattaagtcttaagactatggtttagaacatggatcagaaactacagtctgcagcccaaatccagaccaaatgaagagaccatgttcatttacatacaacctatagcagctttcacactacaggagcagagctaagtagttccaagggaacacacggccctgcaaagcctaaaatatttactctatagctcttcacagaaaaagttttcagatccctcgtttagaactcttgttcatatgcaatttcactaaaccatagttttttgggtttgtttggttttttttggcaaaaaggaatgagccgatccagaaaaggttgaaaagaatgaatcattactgctgaaagaatgtgcacacagtccgtcagtattctgctgccatgctgacacccatccaatagtgtcatgagatgcagcagctactactgtgttctcaatgccgagtccacccactccataaccatgtccaagcaatcttgggaacatcatcaccatgcttgtttatccttaaggtattgcctcacatacagcagtggctggtcataaagtcaaatgacactagtggccaggaggtcaagagaatgagtgaggacaggtgggtaggcagcccaggccctagcaacagcaggagctcacccctcagtcactctagccaggactgaaatacttttcaccctttcaagagagactaggaatctggatttttatgtgaaatatcttgattactaaatgttgtcaacagacatgtcaaaaggtaaaactaagtaagttcatggggcagattgactattcaggttatagaattaaggattcttatccaacacagataccaaccaaaaagctgacgtataacatattaggagaaactatgtgcactgtcgaaacatcaacaaggggctaatgtctaaaatagtctatattggattccagttgaaacatggggaaaggacatgaacaggcaacttatgtcaatggaaactcaaaaagataacaagcatatataaaagcattctcaaattcagtagtaaacagacagatgcaaataaaaagagggaaactgctgccgggcacagtggctcacacctgtaatcccagcactttgggaggccgaggcgggcggatcatgaagtcaggagatcgagaccatcctggctaacatggtgaaaccccgtctctactgaaaacacaaaaaattagccaggcgtagtggtgggcaccagtagtcccagctactcaggaggttgaggcaggagaatggcatgaacccaggaggcggagattgcagtgagccgagaccatgccactgcactccagcctgggcgactgagtgaaactccatctcaaaaaatataataataattataattataataataataaatagtaaataaataaaaagagagagactgctaaagtctagaaagttgaatgatgccaagcgcatgcaaagatcagggccttgggatggccgggtgcagtggctcacgcctgtaatcccaccactttgggaggccaaggcgggcggatcatgaggtcaagagatcaagaccatcctggccgacacagtgaaacccggtctctactaaaagtacaaaaaaatatatatatatatatatattattatattatatatatatatatcagagccttgggaatccttgtgtgctgctggggaaggtagtggtgcagccacccttgacagcaatctggcagtacttggttatattaagtataggcacacaccacgaccaggcagtcctactcctgggtctaaatcccaaagaattctcacacaagtccataaggagacatgtacgaggctcattcagcattactgggagtgggaatcaacctgggtgtccatctacaggagacgagatggacaaaatgtggtggatattaagaccagaatcaccaagtaacagagatgggtggtgagtgacaatcctaagatacagaataaaggctagaacatgatgccattcatgtaaattaaaaatagatgcacacaaagcagtatacgcgtgacccttgaatagcacaggtttgaactgcctgtgtccacttacatgtggattttcttccacttctgctacccccaagacagcaagaccaacccctcttcttcctcctccccctcagcctactcaacatgaagatgacaaggatgaagacttttatgataatccaattccaaggaactaatgaaaagtatattttctcttccttatgattttctttatctctagcttacattattctaagaatatggtacataatacacatcacacgcaaaataaatgttaattgactgtttatattatgggtaaggcttccactcaacagtaggctgtcagtagttaagttttgggagtcaaaagttatacacagattttcaactgtgcaggcaatcagttcccctgaccccctcattgttcacgggtcaactgtatatacacaaaagtattatatgaacctcattagaatagctgtctatagggagaagagaatgagagtgggataaaacggaatgaacaaataaaccaacaaatgcattaacaagcaaaacaacagaggggcttgcatgggccagtgatgataaagggctaagaatgagaatataattaattcaattcctcacacctgaggtctaaaaccaaggaaagggagggccaggcgtggaggctcacgcctgtaatcccagcactttgggaggctgaggcgggcggatcacaagattaggagtttgagatcagcctggccaacacagtgaaagcccatctctacaaaaaatacaagaattacccaggtgtggtggcacatgcctgtagttagctactctggaggctgaggcaggagaatcacttgaacccaggaggcggaggttgcagggagccgagatcacaccattgcactccagcctgggtgacagagtaagactctgtctcaaaaaaataaaaaaaataaaaaaacagagaaagggaggaaactagatccaggctgactagatacagcctttagagttagaaaagatgatttgacaatctaagcccacactcagattgaatgaaattgaaaagcctttcaaactaaaacatttaattacaccatctgctgcagacagaactcagacaactcaaacaggtaatgtcagcgtggtgttttatatcaccaccctcaacacagaataaaaatcagctgcatgtgaagcagtgactagaatgaagaaaaggctgcttcttacttccttctagtggttctttccgaaaacattaataggcaccagctctatgcatgtcaccctgcagggagacatggggtatataactatgacttactgttcattcctcaaggaattcccaatcttgtggaagattatacacaatgaggcaacaaaaactatccaataaaaccacggaaaagaagccagtgacaaagaagccagtgatgaaaggccctgtgagcagagctgatggccatttggggaagaaagaccaacatggatgggggtgatcagggtggctccgtgggaaagctggaagagaagtggcagatctctgagctggatgatgggccactaccatctgtatatggctaattaaagaccatgtgtggattttttattcagctctttcgtgtcattcctgctatcagcacagaacccaatctcaactttccagctatattgagctaaacttctcacctcatggaatttgcagataaagttcaaaaggatccttgccttttcaaaataattttgaatggttgagtagtccctctgtgctctctcactgacaccctctcaaggctgctgagcacgtgccatgctatggctttctccaacatcaggaaatgttctccactcagtttcaccttaatacaaatgtgttctctcttcagagaaggcaaaaaaattcatgaccatctgactgggagaagtcatttctaggtaaagtgtccatctttttctgaggaacacaggaggaaaatcttacagaaaagagttaacacagcaggcctaagactgctttttaaaataaataaataaataaataaataaataaataaataaataaataaataaataaatgaatgatagggtcttctgtattggccaggctagtctcaaattcctggcttcaagagatcctcccaccttggtctcccacagtgttgggattatagacatgagccattgtgcttggcccaagactgttattcttaaaaagtctcataaaaagcatggttaatccttggctggcacctgggaacttagatttcagaagggttcccaccatccaacctggaaagagggactcactgtgcctaaattattgtgtggtttatgctgaactcctgcttttcttcaggtagcgtggaatgtggtatgtgctgggcaaagggggcctgcatgaccagcccccaataaaaaccctgggtgttgggtctctagtgagtttccctggtagacagcatttcacatgcgttgtcacagctccttcctcggggagttaagcacatacatcctgtgtgactgcactgggagaggatgcttggaagcttgtgcctggcttcctttggacttggccccatgcacctttccctttgctgattgtgctttgtatcctttcactgtaataaattacagccgtgagtacaccacatgctgagtcttccaagtgaaccaccagatctgagcatggtcctgggggcccccaacacagaaataaattataaaagaccaaggactgggcatggtggcccatgccggtaatctcagcgctttgggaggccgaggcaggaggaccagttaagcccaaaagttcaaagttacagtgacctatgactgcgccaatgcactctaacctgggagacagagcaagaccctgtccccaaaacaataaactaaacacatacttctgccttccaagtgtcttaaaattcaatggaatggtagaaacatttttaaaacactaaatcaaaagaaacctggaaaacaagagtgccgatggccaactaaaatgtctaggaaatttctgaaaagtaaaaagtactcagaaccagattacctgagcaaaccatagcccaatacaagcttgggaggaggctgttatgcagaaggaaatggtaacaggtttccaggaacagacttgtaacagcagatagaacagcagaggtagaacctgacaaggtgattacctggggaactgcagtctgaatgaccaggactgttggacccttcccctcacatggaatacacacgccactcagcagcacaccacagctcttcaacaatcacaggaggcacgctacgcctagtaagacaggaaaaaaggaattctcaaacttcgaagatgaacacataaagaatcaccaagtttttattcagtatgatgaaacagggacactgaatcaacagaacacaaacccaagcaaagataattactagagcacatagaagaaattattagatattcttgggaagacctaaggggacattataaagagcaagcagttggtatgtgacgatctttgtgatataccaagaaataaaaacacaggatgaagaccagatagagaataatgctactatttgtgcaaaaaaggagaaatggagaatctgattcatatttgcttgtatttgcatgaagaaactttggaaggtacataagtaactaacaacaatggttacctacttgtaaggcgagagaagtaagaggacaggaatggtgggaacaccttttgtgtccggaattggtgggttcttggtctgacttggagaatgaagccgtggaccctcgcggtgagcgtaacagttcttaaaggcggtgtgtctggagtttgttccttctgatgtttggatgtgttcggagtttcttccttctggtgggttcgtagtctcgctgactcaggagtgaagctgcagaccttcgcggcgagtgttacagctcttaagggggcgcatctagagttgttcgttcctcctggtgagttcgtggtctcgctagcttcaggagtgaagctgcagaccttcgaggtgtgtgttgcagctcatatagacagtgcagacccaaagagtgagcagtaataagaacgcattccaaacatcaaaaggacaaaccttcagcagcgcggaatgcgaccgcagcacgttaccactcttggctcgggcagcctgcttttattctcttatctggccacacccatatcctgctgattggtccattttacagagagccgactgctccattttacagagaaccgattggtccatttttcagagagctgattggtccattttgacagagtgctgattggtgcgtttacaatccctgagctagacacagggtgctgactggtgtatttacaatcccttagctagacataaaggttctcaagtccccaccagactcaggagcccagctggcttcacccagtggatccggcatcagtgccacaggtggagctgcctgccagtcccgcgccctgcgcccgcactcctcagccctctggtggtcgatgggactgggcgccgtggagcagggggtggtgctgtcagggaggctcgggccgcacaggagcccaggaggtgggggtggctcaggcatggcgggccgcaggtcatgagcgctgccccgcagggaggcagctaaggcccagcgagaaatcgggcacagcagctgctggcccaggtgctaagcccctcactgcctggggccgttggggccggctggccggccgctcccagtgcggggcccgccaagcccacgcccaccgggaactcacgctggcccgcaagcaccgcgtacagccccggttcccgcccgcgcctctccctccacacctccctgcaaagctgagggagctggctccagccttggccagcccagaaaggggctcccacagtgcagcggtgggctgaagggctcctcaagcgcggccagagtgggcactaaggctgaggaggcaccgagagcgagcgaggactgccagcacgctgtcacctctcactttcatttatgcctttttaatacagtctggttttgaacactgattatcttacctattttttttttttttttttgagatggagtcgctctctgtcgcccagactggagtgcagtggtgccatcctggctcactgcaagctccgcctcccgggttcacaccattctcctgcctcaacctcctgagtagctgggactacaggcaatcgccaccacgcccagctaattttttattttattttttttttagtagaagcggagtttcaccatgttagccagatggtctcaatctcctgacctcgtgatccatccgcctcggcctcccaaagtgctgggattacagacgtgagccactgcgccctgcctatcttacctatttcaaaagttaaactttaagaagtagaaacccgtggccaggcgtggtggctcacgcctgtaaccccagcactttgggaggccgaggcgggcggatcacgaggtcaggagatcgagatcatcctggttaacacagtgaaaccccgtcgctactaaaaatacaaaaaattagccgggcgtggtggtgggcaccggcagtcctcgctactggggaggctgaggcaggagaatggcgtgaacctgggaggcagagcttgcagtgagccgagatagtgccattgccttccagcctgggcgacagagcgagactccacctcaaaaaaaaaaaaaaaaaatagagacccggaaagttaaaaatatgataatcaatatttaaaaacactcaagagatgggctaaagagttgacggaacaaatctaaatattagattggtgacctgcaaaaccagcccaaggaacatcccagaatgcagcccataaagataaagagagcatttccgctgggcacagtggtatggcaggggaattgcctgagtccaagagttgcaggtcacattgaaccacaccattgcactccaggcctgggcaacacagcaatactctgtctcaaaaaaaaaaaaaattaaattaaaaaagacagaatatttgagagaaaaaaatgcttatttcaagaaacatgaaagataaatcaagatattctaattcccaagtaagaataattccagaagcagaaaatagaatagaggcaaggaaacactcaaaacttctccagtgccatagaaatgtgtattaatctttagaatgaaacggactaccaaatgctgagcaggaagaacaaaagagatccactcttaagccagtgtggtgcccaagcgcagtggctcatgcctgtaatcccagcactttgggaggccgaggcaggtggatcacctgaggtcaggagtttgagatcagtcaggccaacatggtgaaaccctgtctgtactaaaaatacaaacattagctgggtatggtggtgcacatctgtaatcccaactacttgggaggctaaggcaggagaatcacttgaaaccaggaggtggaggttgtagtgagccgagatcatgccacactcccagcctgggtgacagagcaagattccatctcaaaaaaaaaatccactcctagacaaataatagttaaattttagaacaccaaggagaaagaaaaaaaattgtaaagcttcagagaaaataaacattaactacaaagaaacgagagtcagacgcgtgcacttcttcctagataccagcagataaagcaatatctccaaaattcagaaggttttaacgtagaatcctatacccagtcaagaatattcacatggaaaagtgaaataaaaaacattgtttaaacatgcaagggttcagaaagtttaccattcacagaatccctgaaaacaaaaccaaataatcacttaaggactcattaagaaaacaaatgaaataaaagcaccaatgatgagtaaataatcagaaaaatttacagtttacctaaataactgtttatgcataatgtatgaaaacccaaaaatttaatatgggacagaattaaaatcatgataagattcttttttgctttactcatggagagttcacataaacagattatcttttaatagcaagagaaaaaaatgtttagatatgtgtgaaaaactaagggtaccaaaacagtgcaaattcatttatcatcaggaaaatccaaattaaaaccacagtatccaccagaataactaaaaggtaaaagacagaaattaccaagagttggcaagaatgtggagcaaccacatatacttctggggtaaataagttggtgcaaccggtactgaaaactgtttgctagtatctactaaaaccgagcacatgcacagactacaaccaagcagttccactcccagatacacactcaacagaaatgcacacactcactcaacaaaagacgtgtactagagtgttcatgtacttactattcataatagtccaaaaatgcaaacaaccaactgccaatcaaagtcaaatgtatatctatattagggatatatacaatggcatatacacagcaatgagaatgaaatgaaccagctcggcacagtggttcatgcctgtaatctcagcactttgggcgggtaaggcaggcagatcacttgaggtcagaaatttgagactagcctggccaacacggttaaaacctgtccccactaaaaacacaaaaattagccgggcatagtggttgcaggcctgtaattccagctactcgggaggctgggttgggagaatcgtttgaacccgaaagccggaggtcgcagtgagcggagatcgtgccactgcactccagcctggacgatagagcaagactccgtctcaaaaaaggaaatcaaaaatataaaataagatgacaggaataatccgcaaaagatcagtaatcaaaataaatataaatgggctaaagctacctattaaaagacaaagatttcacacccataaggatagctactatcaaaaaaagagagagaataacagatgttagcaaggatgtatggaaactgaaattctcacgcattgctggtgagaatataaaatggttcagcctctgcggaaaacactatgctgggtcatcaaaaaattaaaaatagaagtactacttgatccaacaattctacttctgggtatatacccaaataactgaaagcagggtcttgaagagatatttgtacacccatgatcatggcagcattattcataatagctatgatgtggaaccaacataaatatcctttgataaatatatggataagcaaaatgtggtgtatacattcaatggaatattaattagcaataaaaatgaagaaaattctgacacatgctacaacatggatgaaccttgagggcattacattaaatgaaataagccagttataaaaagacaaatactatatgaggtactatattagatactcatgcaaggtacctaaaataggcaaattcatagagacaaaaagcagaatggtggttgccaggggctgcggtaatggatacagagcttcaattttgtaagatgaaaaaattctggagattggttgcataacaatgtgcacacacttaacactggggaactgtaaacttaaaagtagtaaatggtaaaaataaaaataataaataataaattttatgttattttaccacaatatttattaaaagacaaagattaactaattaaacaaaatccagccataagctaatggtaagagtaacaattaaagaagacacagaaaattgaaaatcagtgactagaaaaagatattccatataaatgctaacaaaaagcaagtacagcaatataaagagaatgaacaaaaaaaaaattaaataagatggctcgtttattcccaaaaggtacaattcaccaagaagatacaagaattgtgaacctttaagcacataaaacagcttcaaaaatacaacatttaaagaaaaatatatattaaacatagaaatagtacaaaaacccctacaagaatcataatgggagtcttcaatacaactctccatatcaacaggtcaaacagagaaaaaaaataagttaaggatgcagaaaacctgaattaccatcaataaacttgagattaatatagaactgtatacccaatatactaagagttcagggaacagtcgtgactgacagtggactgcaaattaatctgttcttaatctttgtttttctttcagcactgtggcagaatagagatcctaaaaaccttccagctacaaaacatctttttaaaaatataaaaaaatacaaaaataactctgaaatcaatagaagacacatggtgaaaccaaaattctagaatacagggagaataaaggcattttcagatattacaaaaacagaaaattgatcattgctgaagtaatttctaaagaatgtacttgagggagaagaaaaatgttccaaagaaaagtatctgtgatacaagaaggaatggaaagtgaagaaatggtaaacaggtagataaagctaataaatgttgacctagaaaataacaaaaacaatagcaataatgtctcgttggaagggttgaagtaaaaatacaattaaggccaaatgtgaggtaagtggaatgaaagaattagaagtccttgccttgttcacaggactgattaaataaatgagccaggttttccattcaaacagttaaaacttgaacaaaataaactcaaattaagtagaaagataaaaaacagaaattaatgtcatagaaaaataaaaaatcaatagaattaatcaataaatcctggttaataaaagctggttctttgaaaggattaataaaataatcattaagcaagtctgatcaaaaaaaaagagaaaaggtaccaaaaaaagtactgtatcagaaagagaacatacagatacatacagatatgtaagagtctgttttcttacaccagaatactatatacaacattatgctagcatatattaaatttcaataatgttaatgattttctaggaaaacagaaaatattaaatttactttgaagaaacagaaaaactgagaaaaataaatgatcatgaaaaaaatgaaaaggtaattaaatactgatattaactgcctaaacaacaccagcagcagcccaggcagtctgcagtcaagttctgccaaacttgagggaacagataattcttctattccagagcatagaaaatgatggaaagtttcccaatttaatcagagaggacagcctgatccttgttatgaacacagataaaaatggggtaaactatatgccaaactcagataccaaaaccctaaataagatgctagcttattgatgtgaacaatccaaaagtgcattttaaattagcccagggttttagagaaagaaaatctagcaatgtgaccaccacttatgttaacaattttaagacgaaaatctacatgatcatatcaatgcatgctacacaaaagcatttgggcaaaaaacccaacacccacccttgactttttaaactcttagtaattaggcataaacagaaatgtacttaatgtgatagaatacactcggtgaagatacagagggaatgctccctaaaaccaagcccaagacaaagattcctatttaacctcaatagtcaacactgcagcgagagtaatctatggaagacaaggaaaaaagtaaaaacatgagagacatctgttgtttaacagacaataagatcacctacttggaagaggcaaacgaatcaagcgaaaaactattaaaactgagacaggctttagtatggaggctcagcttcagctgtagtttgggctaccaaattcaactcgcttgcttggagagttaatcctgcaaagctaatttctgttgaggtattaggattgacaagcctgtgctcctccctcctcccccatcttcaacactgaaataacacggtgtttggaactggataacagaatcttccaaaaacaaaaattgtcctgaagggctgacttgtgcccttactcaaaaaacactttatctgctgcctgcagctcctacagttgctggtggataagcctgccaaccagctcggcgtaattcttcctgcagagggcaaggaagagcactttcacaggaaaatttttttccgaactgtatgccgcttattacataaacttacgtgctggcaaatggagctccagcaaaataagatattcagagtcaaacttccttaggaaaaaaaaaaaaaaaaagcaagcacataacactaatttccttgcatgggcactggggaaggaggtcgttacttccgcacgcccgcaggtccgcaccaccgggaaacccacgggcaccgcgcgctgcccccgggccttccaggtgcactgcgccgcggcgccccagctgacccgggatgcgcagccctagcccttcccctgtcaccccggccaggaaggggcgggagcgcggcggacgccgagggcgaagggcttctcggtcctctgcaccacgcagcacccccaaggcacaacagggagggtgcgggaggctcccgagacccaggagccggggccgggcgtgcccgcgcacctgtcccactgcggcgagggctggggtcgcctccagggccgcagctgtcgggagccacctggctctcagtcccgggtccctgcgacaaccctcgggcccggaggggaggaggcggccacctgccgctgccacctgcggcaccggtcccaccgctccgggccgggcaggacaggccaggacgtccctcctgggctggggacaggacacgcgacgaggggaccggggcccccgcggcgaagacgcagcacgccttcccagaaaggcagtcccgtgcccccacgacggactgccggacccccgcgctcgcccgcccatcccttcagaccacgcggctgaggcgcaaagagccggccggcgggcgggctggcggcgcggctagtactcaccggccccgctggctcagcgccgccgcaacccccagcggccacggctccgggcgctcactgatgctcaggagagggacccgcgctccgccggcgcctccagccatcgccgccagggggcgagcgcgagccgcgcggggctcgctgggagatgtagtacccggaccgccgcctgcgccgtcctccttcagccggcggccgggggccccctctctcccagctctcagtgtctcatctccctatctgctcatcctctggtcgcacataatcgatgtttgggcgtcccaagccagatgtggaccccatttccgcactctacactggaggttttctaagggtggtgcccggaccagcagcttcagcctcatctgggaacttgagaaaatgcagattctccgtcccacccagcctattcggtttttcctgcactaaaaccatgaaggtggggcccagcagtccacattctcgcaagcccgtcaagtgattctgaggcgccctccagtttgagagctatgctcacggcctcacctccgccccgcaaggagcccggtcttgcctgtggcgctagccgcacacggacacctcatcctgcggggcccgcccccccgctgcaccctcaccgcccaacgcctcctccgggatgcagcggaggcgcctggaagtcggcaaggtcaacatccccctcagcatcttccctaccctcacggctcctcctccaggggtgcctcatggccaggggttagaaagagccactgtgtttcttgacatggaagtggcctaagaccttaatgaaaactgcaggagtggaatgacagaacctttggtcatacttgagggcgtgaagctcaaatgaggaggaaggaaaggatccagggagaataaccaaccctggcaagttgtggcgcccaggtagaggggcgagcctaggctagcggttctcgaccagggccggtgttgcccctcctcgccgccccgcgtacatttggggaggtctggagacatttttggttgtcatgatgcgggagttgctactgttgcctaagtgggtagacacgagggtgctcctcaacatcctacctgaaggacaggactgccccacaaggaagaatgatccggccccaaataagaaaccctgggctggtcagcaacaacccctttgttctgagaagagaggaggaaagaataaaagaagtggggtgaagttttggtttggtagaggaaacttgaagacattttcactggaaaggaagagaggaagaggagggagatgtctgtaaggacgagcaaaccgggtgacagctgatttcctcatattgaagtaatgagtcctagttataataaattcctaataaaaacccagtttatccctgcaataaacttgtcttttttttttaaatatactgcttgattctgtttgctaatattttatttacaggctttgcattgatatgcaaaaatgagatgggcaataattttctttttgaatgtctaatgttgtttggtttcagaatcaatgttatgctcacatcataaaaaatttggaaccgaggcaggaggagtgcttgaggccagaagttcgagaccagtctaggaaacacagtgagacccccccatctctacaaaaaaaaaaaaagaaaaaaaaatgggcatgtttgctttttccttttactctgaacaatttaaggagcattaaaattatctattctttgaggtttgatcatttcccagttaaaaatgttcctcccagcctgatgctttctttggggagggtaaatcttttaaggctagaaaagtttcttctgtggcaattttattatttacattttaaaaattattctagagttaattttgataaagcatgtatttcttaaaacaaattatcctttttttccagatgttcaagtgtatttgcataaagttgaggaaagtagtcttttgtgaatcttttaacttctcccaaatatcttattttgtgtatttttgcttctttattttgttaacttttaaaagtgtatttttttttcaaagaatcagctcttaggtttatgtttttggttatactggagcttttttcttcttctttttaaaatattttttctcctttattttttagacgtattttgatctaacgtaatcggaagaaggtaaattagaatcttttgttactattgtgtttttatttctccttatttctctgaagtcctgctttataaatagtaccatgttatttgtgcataaatattcatttgtcttatattcttgggaattttcccacttcatcataaaatgaccttccttgtctcatttaatgtgttcaaactttgccctgaatttaactttgtctgatattttaccatcctgctgaattttgtttgttaccccaaacaacctttgctgttttcgtcttttctgaaccctttattttaggtaatcccttgaattagagcactaagttttgctttgtgattaaatctgaaaatctttatcttgccatagatgagttgagccctattcatgtgacagctatattatgctgtttcatagcccttttggtccttttttcactcttgcattgcatattttgtgtttattgtgttttgtgtttcttctgataatttggaaggtttgtatttttattcagggagttgccttataatcatactccgcaatacacatcgtcctcagtttcttcagactgtctgttaactccctattctgaataaaaatgacattgtaatttccctcttttttctttaccccttttcttctcctcacctaatgtaaatgattttatccttctttagtatttgcttttttaattaactacatttataaatatctttatcacttgatttttaaatcagctttgaatgagatatttggattcctagatataaaagatgttaattataccatttccacgttagtaggtttataaaatcatacattctgctgtgtaaccataatcccacgtttgttttagttccactcctacagttaaaagattcagaagtattattaacagttattttgccatagttttttccccaacccattttgtggtaagttatgatcctgctttagtttcttaagaataatttatagagcagagtgtggtggctcacgtttgtaatcccagcactttgggagacaagaggtagaaggatcgcttgaagccagcagttcaagaccaccctgagcaacatagtgagaccttgtctctacaaaaaattttaaaatttagccagacgtagtggcgtgtgcctatagtcccagctactcaggaggctgaggcaagaggattgctagagcccagaagtttgaggctgcagtgacctctgattgtgccactgcaccccagtctgggcaagaaagtgagaacctatctctttaaaataacaataataacttatgaaaattatattccctgagtttttcatgtttaaaaatatttgttgcctttatcctgtaaaagtttgagtataaattcttgggttatactttatttattgaagaatgtataagtattgtcttctagaattgagtgttgctgtaatgaaaccagaagtcagcctggtttatttttcctcagaaatgaggtaattgccggccggacaccgtggctcatgcctgtaatcccaacactttgggaggccgagacaggtggatcacgaggtcaggagattgagaccatcctggctaacatggtgaaaccccggctctactaaaagtacaaaaagttagctgggcatggtggtggacgcctgtaatcccagctacccgggaggctgaggcaggagaatggcgtgaacctgggaggaggagcttgcagagagctgagatcgcgccactgcactccagcctgggcgacagagtgagactccgtctcaaaaaaacaaaaaaaaaacaaagaagtgaagtaattgccatgatgctccaagaattatctctttgtctatgaaatccagaaatctcactgttatacattttggaattattattctgggccaatatttcctgggacacaatagattgactctatagatttaattttttttttttttttgagacagagtctcactgcaatctcagcttactgcaacctctgcctcacgggttcaagcaattctcctgcctcagcctcccaagtagctgggactacaggcgcgtggcaccatgcctggctaatttttgtctttttagtagagacagggtttcaccatgttggccaggctggtcttgaacgcctaacctcaagtgatccacctgcctcagcctcccaaagtgctgggattacaggcgtgagccaccatgcccagcctcaattcctctttctatctggtaatttttctgaagttgaaaacatttgttctaatacgttatttcagtgttcttctaagatgtgtaaagcaccctattcccaggtcagcccccatcttgctagtgagctcggctggttcttcacaagagctctggttttctcctgcttaatctcaagtacctctgtcagcctccacctggtttatgatttggagttttttggtttttgttttttgtttttgacagagtcttactctgtcacccaggctggagagcagtggcataatctcagctcactgcaacctctgtctcccaggtttgagcgattctcctgcctcagcctactgagtagctgggattacaggcgcgtgccaccacacccggctaatttttgtatttttagtagagatggggtttcaccatgttggccagggtggtcttgaactcctgacctcaggtaatccacctgcctcagcctcccaaagtgctgagattacaggcgtgagccaccgcgcctggcatggtttggagttttaatctgtagttttaataaagatagtgcttatgtttgtgtttcttatatttcttggtactcttgggtaatttgtaagatccccatatctacacaagaagtccattttcaattcttttcttcagactgtttattttattttattttattttatttttatgtttgagatggagtctcgctgtgtcacttctggaggctggagtgcagtggcgcgatctcaggtcactgcaacctccgtctcccgggttcaagcaattctcctgcctcagcctcccgagtagctgggattacaggcacctgccactttttaatttttttagagacagagtctcgctttgttgaccaggctggagtgcggtggtgcaatcatggctgactataacctccaaatcctgggctcaagtgatcctcctgcctcagcctcctgagtagctgggactacaggcacatgccaccatgcccagttaattttaatttttttgtagagacagggtctccatatgttgcccaggctggcctcctactcctggcctcaagtaatcctcctacctcagcctcccaaattactaggattataagcatgagccaccatgcccagccttgttctactactttaatttcatatgttaggtgaccatgtaattgatcatccaaaccaggatactgtaagaatgaaagaggctgacagtagtatgatgctgggactagcattgtgcactgagattatttctgggaaagcaggagatacggtcaccctacttatagtgtgcttgtctttggattgttgaatttggagtttctatttgcaggcttatttcaactgggcagccttgatccgccctgcccagcaatgctaccgttctctccaccgggtctctgggaccccttcagtcactatacttagctcagttccccaccctcccactccctaaaagcgtaaccaggaatcctgcctcaggtctactgccgtcttccgtgggctgtttcagttcctattacccagagtcaaactcccagcattccctacctgattccagacttggagtccagagctttaacctcttcaggccaactccccactttgcatttctgtccctatatcttagtccatggagatacatttcatgtctttgagtctacttacaaagtaaattttgctgttttttaattttttttttgagatggagtcttgccctgtcacccaggctgtggtgcaatgacgccatctcggctcactgcaacctccgcctcctgggttcaagcgattcatctgcctcagcctcccaagtagctgtgattacagacaggcaccaccacgcccagctaattttttttatcttttagtagagacagggtttcaccatgttggccaggctggtcttgaattcctgacctcgtgatctgcccatctcggcctcccaaagtgctgagattacaggcgtgagccactgtgcccagccaattttgctttttttatatttcattgctatatgtttagaggataagtttacagtgctatatgcattcccaaatattagaccaaaaaaatctccaaaaaattagaaagaaaatccaaaaaatctcaaaaaataccaaaaagcaacaatctcacagaccatactcactgacccccaataaaataaaattagaaattaaccacaacttaacaaaataaagtactcaagtcagagaggaaagaggaaataaacatcaaaattacaaagtctaggcggtggctcacgcctgtaatcccagcactttgggaggccaaggcgggcagatcacaaggtcaggaattcgagaccagcctggccaatatggtgaaaccccgtttccactaaaaatacaaaaattagccaggcatagtgatgtgtgcctgtaatccagccacttgggaggctgaggcaggagaatcactgaacccagggagacgaagattgcagtgagccaaaatcgtgccactgcacttcggcctgggtgacaaagcgagactccatctcaaaaaaaaaaaaattacaaactctttagatagaaattttggtgtttttttttgagacggagtctcactctgtcgcagaggctggagtgcagtgggactatgtcagctcaccgcaacctccatctcctggattcaagcaattctcctgtctcagcctcccaagtagctaggattacaggcgcccaccaccagacccagctagtttttatatttttagtagagatggtgtttcaccatgttggccaggctggtctcaaactcctgacctcaagtgatccacctgcttcagcctcccaaagtgctcagattacaggcgtgagccaccgcaccccacctagatagaaatttcaacatgaggccgggcacaatggctcacgcctgtaatctcagcacttcaggaggctgaggcgtgggaggatcacttgggcccaggagttcaggaccagcatgggtgacagagacagaccctgtctctatttatttgaaaaaaaaaaaaaaaaagagagagagaaagaaatttcaacatgaaaagtatctctcaaacccttcgagatgttggcaaaaagcgactcaaaggaaaatgtattactgtgtgtgaatttgcttgaaaataagaaagaggccgggtgtggtggctaacacctgtaatcccaacactctgggagtccgaatcaagtggatcatgaggtcaggagatcgagaccatcctggctaacatggtgaaaccctgtctctactaaaaatacaaaaaattagctaggcgcggtggctcatgcctgtaatcccagcactttgggaggctgaggcaggtggatcacctgaggtcaggggtttgagaccagcctggcctacatggtgaaacctcgtctcttctacaaatacaaaaattagctgggcgtggtggtgggtgcctgtaatcccagctactcagaggctgaggcaggagaatcgcttgaacccgggaggcggaggttgcggtgagccgagatcgcaccactacactccagcctgggcaacagcctgggtgacacagtgagactccatctcaaaaaatacaaaaaattagctgggtgtggtggcctgcgcctgtagtcccagctacccgggaggctgaggcaggagaatggagtgaacctgggaggaggagcttgcagtgagccgagatcccaccactgcactccagcctgggcgacagagcaagactcttgtctcaaaaaaaagaaaaaaaaaggaaaaaagaaccctgataataaagaaaccaaatgttcaactctcaaagctcggacactttaaagaaataattaataaaggcagaagttaaagggaggatgataaagcaattttttttgttggtttttttgagatggagtcttgctctgtcacccaggctggagtgcagtgatgcgatcttggctcactgcaacctctgcctcccgggttcaagcaattctcctgcctcagcctcctgagtagctggtactacaggtgcgcgccacctggcccagctaatttttgtatttttattagagacggggtttcaccatatttgttaggctggtctcaaactcctgatctcaggtaatctgcccacctcggcctctcaaagtgctgggattacaggcaggcgccaccgcgcctggcctaaagcaaaatattggttctgtgcaaaaggtcaataaaaagagcaaacgtttacaaactggagccagcacccattcagctcagtgtgtctggagaaaaaacaatctcgcttcagaattcatgattacgcagccctttttgcttcctaaaaatcctactatgttgctgttgaccattctctctctttctctctctcttgctttctctccagaaaagctattcagacattctcctctttcctcaaacctccaacacttcctcctccatccttagcctcagctgctgacctcacttctaatcattgagaaaccaggagaagcatttaagagtgaacctccgcctccccgcacgggcaaaaccacccacccacagaattgtgccccaattctgcgtcctctcctctcaccatggatggacggtccaggctccgagccaaagccaggcctcccctggagctctggatccaccacctgcagcttctcaggcagggccccagcagctcccctgctcccttgtaccatcaatccctcccctcactgggtcactcccaacaatatatatatttagtgatgtttctcccatgtggtaaaatcacttagcctctctcctcccccagctactatcctatttgtttctttccattctctgcaaaacttctcaaagcattgtgtctatgtgctgactccatttatcttctcccgttctctgctgagtccttcccacagactctcaccccagttactccatgaaatgacctctgcactgccacatccaatggtgaatgttcagttcttaattttattcagtctttcagcagcatttgacctggccgatcactccctcttcttaaaaatacttttctcagccaggcgtgatggctcacacctgtaatcccaacactttgggaggccaaggcgggaggatcatgagagcccaggagttcaagatcagcctgggcaacatggcaagaccctatctctacaaaaactaaaaagtagccagtgtgatggcatgcacctgtagtcccatctacttaggaggctgaggcagtaggatgacttgagcctgggaaatcaaggctgcagtgagccatgattgcaccactgcactccagcctgagtgacagcgagaccctgtctcaaaaagacaaaataggaaacttttctcagcatattcctctgattctcctgctgcttctgtctgcacagattcagtctcctttgccggttcttcctcatcctcctgatctcttgaccttgaagtgccccagagtacagtctttttttttttttttgagacgcagtctcgtctgtcacccaagctggagtgcaatggcgaggtctcagctcatgcaacctctgcctcctgggttcaagcgattctcctgcctcagcctcccaagtagccaggactacaggcacatgccaccatgcccagcaaattgttgtatttttagtagagacagggttttactatattggccacgctggtctcaaactcctgaactcgtgaaccacccgcctcggcctcccaaagtgctgagattacaggcatgagccaccacacccggcccagagtacagtctttagacggcctctctacctatacttgctcccctcataaactcctcctgcctcatggctttaaataccatcggtagactgatgactcccatatttctcttttttttttggagacggagtctcgctcagtcccccaggctggagtgcagtggcgcgatctcggctcactgcaagctccacctgccaagttcacaccattctcctacctcagcctctccagtagctgggactacaggcacccgccaccacgcctggctaatttttttgtatttttagtagagatggggtttcaccatgttagccaggatggtctcgatctcctgacctcgtgatccgcccatctcggcctcccaaagtgctgggattataggtgtgagccaccgtgcccagccgatgactcccatatttctatctcttgctgtgtgggagttctcctcagaactccatactcataaatccaactctcataaatagtatctcaaatgggcaatatgctcaaaagtcaattcctacttttctccctaaacttgctttcctgcagtctccaccatcttaatgtccaatctaacattaggaggcaaaaactttgaagtcattcttgactcttctctattacacaccctatccaatctttctgcagatccagtcgacccccaaatccagttagctctcatcatctcccctgttaccccctggtccaggccatcttcctctctcacctgaatcactgcagcattctcctcactggtctctttggttctgttttcactccaccttagcatagtctccacagagcagtcagagggatccttttaaagtgtaattcccatcctgtccctgctctgctcaaaaccctgtcgtgattcccgttttaatctgtcagattaaaagccagagtctttccagtgacctacatgatctgcctattatcacctcccacttctttccccttgctcactccactccagctctgcagctgtcctttctgtttcctgaacagcccagattttgcttctttagaacctttgtatttgctgtcccctctgtctggaatgtttttccaggaagtcacctggctctctcctgcacttccttcctgaccaccatgtttaaaaatcactcaaacacacttcaggccggacatggtggctcacgcctgtaatcccagcactttgggaggccaaggtgggtggatcacctgaggtcaggagttcgagaccagcctggccaacatggtgaaacttcgtctctactacaaatacaaatagtagccaggtgtagtggcacacacctgtaatctcagctactcaggaggctgaggcaggagaatcgcttgaacccagaaggcagaggaggtgcagtgagccaagatcacgccacaacaccccagcctgggtgacagagcaagaccccatctcaaaaaaaaaaaaagaaaaaaaaatcacacaaacacacttctcttcatattccttttccaagttttatttttctccagaatactttacattgttttaatggaagttctccgtttccccccaactagaatggatacttcctgcaggtaggcactctagtcctcccatccaagtactaaccaggctcaaccctgcttagcttctgagagcaggggagatcaggcctgttcagggtggtatggcccaggaattttgattctgttttattcattgctgttctgttgattctcttttgttcctcctcctagtgctgagaacactacttgtacataataagcattcaataaatatttgttgaatgaatgacttgttgaatgaattaatctcagaaatgcaggactggttctacattagaaaatttttcaaggtcattctctgttgtcgtaacacattaagagaggaaaattttgtactctaaatcatttgataaaatacatactgatttctgttttcaaaaactcttagtggctgggcgaggtggctcacatctataatcccagcattttgggaggacgaggtgggcggatcacttgaggtcaggagtttgagaccagcctggccatcatggtgaaaccctatctctactgaaaatagaaaaattagccgggtgtggtggcgcatgcctgtagtcccagctacctgggaggctgaggcaggagaatggcttgaacccgggaggcggaggttgcagtgagccaagatcatgccattgcactccagcctgggtaacagagtgagactccatctcaaaagaaaactcttagtgagtttaggaatccaaggaagaccctcaaactaaatagataatctagctaccagaagccttcagtaaaccttaacactccatggtgaaacattagaaacattcctactaaaagacaggctaagaatgcctgcaatcttcacggctagtccaagaagtcaaaaagaagaaatgagcgctgatttaaaaaaataaacaaacaaaaaactaccgatgcagaggctggcagcaaggactgaaggactgtacagtacttgcctggagcaggcggatggccacacccctgcgaagcctgctcagctggctgggggacgctccagtgtgtgagtggcaggatgcagggtacttcctctgccagggagttgcactggggagatcctcccccactcacactttggcagctggggctttggaatgtgacttagcttctgtcaaagggtcaatccaccctttgatatatgatgcaaaggcgaacatatgatgcaaaggtgagagaacagcccaaattaggacttttaccacagctgtggaggtggacagcgacagtggtgggccctggccagacttttcatgctcaaaggtggtggttgttcttcctacttcttgtccctccagggcttcctttgcctgtgtgctgaacctgcttcttttaattttttttaacttttttaaatttttaattgttttaattaaaacaaattttgaaaactgtctgaacctgcttttgaaccctgctatgatttgaatgtttgtcccctgccaaactgattttgaaacttaatctccaaagtggcaatattgagatggggctttaagcagtgactggatcatgagagctctgacctcatgagtggattaatggattaatgagttgtcatgggagtggcatcagtggctttataagaggaagaattaagacctgagctagcatggtcgccccttcaccatttgatatcttacactgcctaggggctctgcagagagtccccaccaacaagaaggctctcaccagatacagctcctcaaccttgtacttctcagcctctgtaactgtaagaaataaatgccttttctttatgaattacccagtttcagatattctgttataaacaatagaaaacgaactaaggcaaactctcatgattctactgccatgccattccaataaactccctttatgcttaagagagccagagttggccaggcgtggtgactcacgcctgtaattccagcactttgggaggccgaggcaggtggatcacaaggtcaggagatcgagaccatcctggctaacacggtgaaaccccgtctctactaaaaatacaaaaaaattagctgggcgtggtagtgggtgcctgtagtcccagctactcgggaggctgaagcaggaggagaatggcgtggacccaggaggcggagcttgcagtgagtcgagatcgtgccactgcactccagcctgggtgacagaatgagactccgtctcaaaaaaaaagagagccagagtttatttctgttgcttgcaaccaagaaatctggctggtgcactgaagtttccataaataatagcaatttaaagactctttccaagccaggcaatgcctagccttgtgtagtccttgtggtaatacattcattcattcatttgttcaaccaactgtgctccagagactaagaatacaaaaatgggggccgggtgtggtggctcacacctataatcctagcactttgggaggccgaggcaggtagatcacctgaggtcaggagttcgagaccaacctggccaaaatggtgaaacccctactctactaaaaatacaaaaaattagctgggggtggtggcggacacctgtaatcccagctactcgtgagactgaggcaggagaatcacttgaacccgggaggcagaggttgcagtgagccgagatcgcaccactgcactccagcctgggcaacaagagcgaaactccacctcgaaaaaaaaaaaaaaaaaaaaagagggccggggctgggcgcagtggctcacgcctgtaatcccagcactctgggaggccaaggcaggagaattacgaggtcagcagatcgagaccagcctgaccaacatggtgaaaccccatctctactaaaaatacaaaaattatccgggcgtggtggcgcacacctctagtcccagctacttgggaggctgaggcaggagaatcgcttgaacccgggaggcagaggttgcagtgagccgaaatcatgccactgcactccagcctgggtgacagagtgagactccgtctcaaaaaaaaaataaaaaaaaaaaaagaattcaaaaattgtagagttatagtgtgcttctagtttagttgagaggacatctgtccttcaaggaaggctagaatctataccctgagtccttactgaaatcaatccagcagtcaaaacatgggaccaacgatcacagcagtaagataggaagagcacctttgtacatttagctcatgttgagataagccactgacagagctgaaggaagctcacagttctgggttccatcctttggcatttaaaaagaaaagtgctaagaaaattcggttggtcacggtggctcacgcctgtaatcccaacactttgagaggccaaggcaggcagatcacgaggtcaggagttcgaaaccagcctggccaacatggtgaaaccccgtctctactaaaaacagaaaaattagccgggcatggtggcgcatgcctataatcccagctactcaggaggctgaggcaggagaattgcttgaacccgggagggggaggttgcagcgagtgagagcaggccactgcactccagcctgggagacagagcaagactctgtctcaaaaaaaaaaaagaaaaaaagaaagaaaggaaaaaaagaaagaaaaaaaaagaaaaaagaaaattcaggccaggccaggcctggtggctcacacctgtaatcccaacactttgggaggctgaagcgagacggtgccttagcccaggagtttgagaccagcctgagcaacatagcgagaccctgtctctataaaaaaaaatttttttttggccagacgcagtggctcacgcctgtaatcccagcactttgggaggccgaggcaggtggatcacgaggtcaggagatggagaccatcctggctaacacggtgaaaccccatctctactaaaaaatacaaaaaattaaccgggcgtggtggcgggcgcctgtagtcccagctactcgggaggctgaggcaggagaatggcgtgaacccgggaggcggagcttgcagtgagccgagattgcgccactgcactccagactgggagagagtgagactccgtctcaaaaaaaaaaaaaaaaaaaaaaaattaattgtcaggtgtgctggcatgcagctgtagtcctagctactcgggaggctgaggtaagaagatcgcttgagcccaggagttcaaggctgcagtaatagtgcctctcactctaccctgggtgacaatgagaccctctctcaaaaagaaagaaaaaagggaaagaagaaaagaaagaaagaaagagaagaaaggaaggaagaaagaaagaaaaagaaaaggaaggaaggaagaagaaaaaaaaagaaagaaagaaaagagagagaagttcaaagaccaaagggtcaggatcccaaaatagtttttatgttttatttatttatttacttatttatttttgagacagtatggctctgtcgcccaggctggagtgcagtgatgcgattgcggctcactgcagcctccaaactgggctcaggtggccctcccacctcagcctcccgagtagctgggaccacaggcgcgtgccaccatgcccagctaattttttaattctttgtagagatgaggtctctatatgctgcccaggctggtctcgagctcctgggcttaagccatccacccgcctgggcctcccaaagtgctgggattacagaagtgagccaccgcgcctaatcgggtggtttgtttgtttattgacggggtctcgctgctgcccaggctggagtgccagtggctgttcacaggtgcagtcctggagcattgcatcagctcttgggctctagcgatcctccagagtagctgcagctgggattccaggcgcgccaccgcgcggggctcagaatgggtttttatattgagggttatgctgccacctagaggatatatgtagtaccgaactgtgtgcgcagggaggctgaggttgcagtgagccaagatgatgccagggcactccagcgtgggtgacagagcaagatttcatctcaaaaaaaaaaaaaaaaaaaaaaaaaaaagaattgaaagtaaggtcttgaagagatatttgtgcctgtatggtcatagcagtattaactttgacccactagctaaaacacaaaagcaacatgtgtctgtcagcaggtgaacggataaacaaaatgtggtatatatgtacaattgaatattattcagcctttaaaaaggaataaaaggctggatgcgggggctcacgcctgtaatcctaacactttgggagactgaggtgggtggatcacccgaggttaggagtttgagaacagcctggccaacatggtgaaacttcatctctactaaaaatactaaaattagccgggcatggtggcacttgtctgtaatccaagctactggggaggctaaggcaggagaattgcttgaactcaggagccggaggttgcagtgagctaagatggcaccactgcactccagcctgggcaacagagtgagactccatctcaaaacaaacaaacaaaaaattattatttccaaagaaacaagaccctgggtccatttcccagcccacacctgatgttgactcacaacacacagcctggtttgctatgagcctgcttcatttaattgtcaccttaacttcacatcaccctcaagtcctggaataactctttgctgacctttgtgtgctgagccatctccatgtcgctcaacgtgcagtccctctcactgcactgagtcaatagccagacgtggtctgactgcagggtcatccttggtggcttaggctgactcgggcatagcagggtgctctgagacctcaccgcatataggctttgcccccaataaactctatataatattcatattatgtggtctgggtgtgtgtagctttgcactgtcttctcgtgacagtgccctcaacctctttcccaggatttcctcctctacctcctcaagtcccactgctctgcaaagaccaaaagctgcagagtcccagctccctcctttacaccccacgacgcagcctcctctctcagaaccctttaaacagagtcttttactgcagatcccaagaacagccacacccctctctcccacccactccagacacacccaggtaattatagcacccagggtaactatgtagatggagtccctggaacatgtggatagtgccccctgggagtatgcaaaagcaacattgctggcacctgcagagaacagggtgacatccaggaatcagagcatgggcctctgggaggtagggatgtggccaggcaggctgccaaaaattggtagagcaaggccacaggatctttctgaccttccttccaaacagaggctcctgtactggtgatccctgtgttgattgaccactcccttcctgggggtcgtggtctctgtcccagttgcccggacttctgtgagtgtcctactgaggtccttttcatgagaagcatgctgtccttccacctgctgggagcaagagtgacaacttcaatactataatagcagtggcatacagagaagaagaaagatgaagtggcaagaaaaacaggcttccaagcaggagtttttctataaaaacaaaaacgtttacaagcaaactttttataaagggctagatagtaaatattttaggctttgagagccacatagacttgtttgcagggactcaatgtcgctattgtagtttgaaagcagccatcagggttatgtaaatgagtgagtctgattttgtttcagcaaaattttatttaccaaaacagacaatgagtgggctggatttggcccatgatccttagtttgccaactcctgctttgggctcacccagatctgattttgaattctggctctgctactggttagctgcaggagcttggaaggctctctgagcctgtttcctcatctgtaaaattaaagcaataatttctaacactcaagagtgttacctcacgcctgtaatcccagcactttggaggctgaggcaggcggatcacctgaggtcagaagttcaagaccagcgtggccaacgtggcaaaaccctgtctctactaaaaaatacaaaaagtagccgggcatggtggcgcgcatctgtaatcccagctacttgggaggctgaggcagggatactgctagaacctgggaggtggagcgtgcagtgagtggagatcacacctccacactccagcctggccgacagagcgagactccatctcaaaaaaaaaaaaaaaaagagtgttagaaggttttgagataatgaataaaagatgccttgtgtatactaagtattcaacaactgatagctgcattggtctaattataacagtttagaagcgattgagtcaacaaatgctggatttgtcagggaggacttcctatcaggaggtagatcttgggctgagtcctgaagcaaagataggcattggatagaggagttgagagaacaccctaggactgttattattattattcgacacggagtctcttgctctgtcacccaggctggagtgcagtggcgcgatctcggctcactgcaacctctgcctcccaggttcaagcgattctcctgcctcctaagtagctgagactacaggtgtgtgccaccacacccggctaatttttatatttttagtagagacagagtttcaccatgttggccatgctggtctcgaactcctgacttcaggtgatccacccgcctcagcctcccaaagtgctggaataacagatgtgagccaccgcacccagcccagaaccatttttcaatccttggctctgccttttattagctgcaagatctcaggcaatttatttaacctctccaaagactcattttctcattcacaaaatgaggcaaataataatatctactatcccaggttgtcatgagaattaaatgcaacatgacatttaatgaaatgagaagtcccttggacattaactggctaaagtatgtgctcgacaaggatatcattttaggtggatacttagcatctcagaactgatgctcacaatggaatatcattgaaacgcattaaaattcattttaaatgattgtaggtagtgaggcaattgaaagaagaagacaagaggactgattataatgcttcaggctcactagtctccttttaggagggaaaaacaatttcaagttaaattttaggctctagatttttacccctgctgctcattagaatcacccagattgatgaaatcagagcccatctgaggctgtgtttttcatctccagaatgagagctgttgtggggattaagtttttgaaaaagtacatctaacaggtgatcgaaaatgatagtgatattattgcagtgatggtcattattgttgttattattatactgaaagaggcttcagttttctgatccataaagtgagggaattgcatgagaccattgctaagattccttctagctctgtttttttgtttttgttttttagacagagtctctgtcgcccaggctggagtgcaatggcatgatcttggctcactgcaacctccgcctcccgggttcaaatgatcctcctgtctcagcctccgaagtagctgggactacaggcacacaccaccatgcccagctaacttttatatttttaatagaggtggggtttcaccatattggtcaggctggtctcaaactcctgacctcaggtgatccacccgcctcggcctcccaacatgctgggattacaggcatgagccactgtgcccaaccccttctagctttcttgatcactgattctagggttctctgctgaaatatatttgagacatcctggataaaagatcatgcaagagctcccaatatggtattaataattgattctggaggcttagctactcctgatggattagacatgactcaactgcctctcttatgtgtacaacacaacaacacaaccaagaaaggttattctggcattccatttattcagtttatttacagcccttacttccagcagcacgttaaagatatggccagggccgggtgcagtggctcaagtctgtaatcccaggactttgggaggccaaggtgggcggatcacaaggtcaggagtttgagaatctggcaattcttcagacttagaagcaaccagctcgataacacagtcttgtgtgggctctccctctgtccctccctcgcttccctcatttctcatccctgcccctgagactgtgcaccttcacatagccctgccatgagaccttcatctcaggctttgctttctggggtaactgaggctaaacactgagtggccctaaaagaggattgggatttggaagttagattattcaccagagaacagactttgctgatgatcaggcccaggttgtaattgttgaaaaaaagagaggatgcatagtcttatctcatctcctagtcaaagtcaacaccatgataaataagagtcaaatcctgagatgtgaattggggacatttgagtggttaaccctgagaagcttgcaccttcagacccctcaatacccctgctccccagagaaggctggacattgacctcagcacaggcaggagccctgcaagatgccatttgtcctactaaagatggacccctccactctgtttctaggtaaataaccaaagtcaagtctccacacagcctgagcaagaaagtcagagcctgctacaggagaaaataccacactggccaaaggattcactagccctggccactgtgtgtgggaggaaccagggaatcatgtgtgggagtcaatgttgaagctgttggactgggggtggggtggaatataagcctggccctggggagtttttcccgtttgagggcctttacccacaactcaagatccagtgctatagcaggagatcccagagctagtcctaacagatggtcaggattgaacttggcctagagtaaaatgaggaggatagtgccagaactttctcaacatactattgaggaagaggtcagaaggcttaaggaggtagtgtaactggaaaggggtcctgatccagaccccaggagagggttcttggaccttgcataagaaagagttcgagacgagtccacccagtaaagtgaaagcaattttattaaagaagaaacagaaaaatggctactccatagagcagcgacatgggctgcttaactgagtgttcttatgattatttcttgattctatgctaaacaaagggtggattatttgtgaggtttccaggaaaggggcagggatttcccagaactgatggatccccccacttttagaccatatagagtaacttcctgacgttgccatggcgtttgtaaactgtcatggccctggagggaatgtcttttagcatgttaatgtattataatgtgtataatgagcagtgaggacggccagaggtcgctttcatcaccatcttggttttggtgggttttggccggcttctttatcacatcctgttttatgagcagggtctttatgacctataacttctcctgccgacctcctatctcctcctgtgactaagaatgcagcctagcaggtctcagcctcattttaccatggagtcgctctgattccaatgcctctgacagcaggaatgttggaattgaattactatgcaagacctgagaagccattggaggacacagccttcattaggacactggcatctgtgacaggctgggtggtggtaattgtctgttggccagtgtggactgtgggagatgctactactgtaagatatgacaaggtttctcttcaaacaggctgatccgcttcttattctctaattccaagtaccaccccccgcctttcttctccttttccttctttctgattttactacatgcccaggcatgctacggccccagctcacattcctttccttatttaaaaatggactggggctgggcgcggtggctcatgcctgtaatcccagcactttgggaggccgaggcgggcggatcatgaggtcaggagatcgagaccatcctggctaacacggtgaaaccccgtctctactaaaaatgcaaaaacattagccaggcgtggttgcaggtgcctgcagtcccagcggctcaggaggctgaggcaggagaatggcgtgaacctgggaggtggaggttgcaatgagccgagattgtgccactgcactccagcctgggtgacagagcgagactccgtctcaaaaaaaaaaaaaaaaaaaaaaatagctgggcatggtggcgcgtgcctgtaataccagctactctggaggctgaggcaagagaatcgcttgaacccagtaggcggaagttgcagtgagccgagatcttgacactgcactccagcctggtgacagagtgagactctgtctcaaaaaaaaaaaaaagaaaaaaaaagacagaaagaaagagcacagacagagtcacaggtatttgcagtaggaagctgtcaggttagagtgcacggaaatagaaagtatattttacacttacagcacatcttcgtttgattagccacatttaaaatactgaatagcaacgtgtggctatttagtattcactaaaatcttggacagtgcaagtctaaagaatccttgatccgtccggcatggtggctcacgcctttaatcccagcactttgggaggccaaggtggaaggatcacttaaggtcaggagttcgagaccagcctggccaacatggtgaaacctcgtctctactaataatacaaaaaaaattagccgggcatggtggtgcatgcctgtaatcccaggtacttgggaggctgaggcaggagaatagcttgaatccaggaggcgctgcagtgagccgagatcatgccatgccactactgcactccagcctgggcaacagagtgagactgtctcaaaaaaaaaaaaaaaattgttgggcgtggtggctcacgcctgtaatcccagcactttgggaggctgaggggggtggatcacctgggttctggagttcgagaccagcctggccaacatggtgaaaccccatctctactaaaaatacaaaaattagctgggcgtggtggtgggcacctgaaatctcagctactcaggaggctgaggcaggagaatttcttgaacccaggaggcagaggttgcagtgagccaagatcgcgcctctgcactccatcctgggtggcagagcaagactatgtctcaaaaaaaaaaaaaaaaatacttgattgtctggacattctgcagaacatcatatggagacactatgttgacgacatcatgctgattgtaagcaagaaatggcaagtgttccagaaacacagtcaagacacatacatgccagaaggtgagatataaactctactaagattcagtggcctgccacactggtgacatttttaaacctgctagatgtttgtgtagaaaaggatttaaccttgcccaaagaggggtctggcctttgtccccagctactggacataatctctttaaactcttgaaatatcattcctgatagaagtatttttgttttgactaggggccttgggccagccagatagcaacaatgtgatctgggttgggggctttggatcaggtggcatcagtgtgacctcctgagtggctagagactagaatcaaccacatgggcagacaacccagcttacatgatggaattccaataaagactttggacacaagggcttgggtaagctttcctggttggcaatgctctatactgggaaacccattctgactccatagggagaggacaactggatattctcatttggtacctccctgggctttgccctatgcatttttcccttgtctgattattattattattatgagatggaatctcgctctgtcacccaggctggagtgcagtggaatgatctcaactcactgcaacctctgcctccccggttcaagcgattttcctgtctcggcctcccgagtagctgggactacagatgcataccaccacacccggctaatttttttgtatttttagtagagacggggtttcacgttagccaggatggtctcgatctcctgacctcatgttccgcctgcctcggcctctcaaagtgctaggaatacatgtgtgagccaccgcgcccagcccccttggctgattattaaagtgtatccttgagctgtagtaaattataaccgtgaatataacagcttttagtgagttttgtgagcacttctagcaaattatcaaacctaaggatagccttggggacccctgaacttgcagttggtgtcagaaataagggtgctcatgtgtgtaccatgccctctaattttgtagttaattaactttcacaactttattattaccgcttacactcaatgtttattcacatttatccacataccacttattctagtgccttgcatcaaagactttctatctcatgtactttattctgcttgaagtaaatcctttaggatattcttttttttttttaaactttgcacatacatacttttattttttatttatttttaattttgttatttttgtgggtacgtagtagatatatgtatttatggagtacatgagatgttttgatacaggcatgcaatgtgaaataagcacatcatggagaatggggtatccatcctctcaagcaatttatccttcaagttacaaacaatccaattacactctttaagttattttaaaatgtacatttaattttgtattgactagagtcactctgttgtgctatcaaatataattttttttttttttgagacagagtctcactcagtggcccagactgaaagtgcagtggcacaagctcggctcacttcaatctctgcctccctggttcaagcgaatctcctgcctcagcctcccacatagctgggattacaggcacacaccaccatgcccagctaatttttatatttttttagtagagacgggttttcgccatgttggccaggctggtcttgaactcctggcctcaaatgatctgaccacctcagcctcccaaagtgctaggattacaggcatgagccaccacacctggccaaaatagaatattctttagtgaggtctgctggtgacaatttttttcttttttttgagactgagtctcgctgttgtcagcttgggctggagtgcaatagcacgatctcagctcactgcaacctccacctcccggattccagcaattctcctgcctcagcctcccaagtagctgagagattacaggcacccaccaccacacgcggctaatttttgtatttttagtagaaatgggggttcaccgtgttggccaggctggtctcgaactcctgacctcaggtgatccacccaccttggcctcccaaagtgctgggattacaagcatgagccaccacgcacagccaattttttccgtttttgtctgaaatcttattttgtgtcatctttgaaatatatttttgatggatataaaattgttggttgatagttattatcattattattattattttgagacagggtctcactctgttgcctatgctggggtgtagtaatgtgatctcggttcactgcagacttgacctcctagggctcaggtgatcttcccacctcagcctccctagtagctgggactacagatgcatgccaccatacccaactaatttttctattttttgtagagatgaggctttgccacatttcccaggctggtctctaactcctgagctctagcaatccacccaccttggccttacaaagtgctgggccatgactagccagcagttactttttatagcatattgaatatttaatatgaatcttctggcatccactgtaactgtttaaaaaatcagctgtttacttggcactcttttttttttttttttttttgagacagagtcttgccctgtcgcccaggctggagtgcagtggcgtgatcttggctcactgcaagctctgcctcccgggttcacgccattctcctgcctcagcctccggagtagctgggactaaaggcgcccgccaccacgcccggctgatttttttgtatttttcgtagagttggggtttcaccgtgttagccaggatggtctcgatctcctgacctcgtgatctgtccgcctcggcctcccaaagtgctgggattataggcgtgagccaccgcgcccagcctcttttttttttttttttagacggagtcttactctgtcatctaggctggtgtacagtggcgtgatctcagctcagtgcaacctccacctcctgcctcagcctgccaaatagctgggattacaggtgcgtaccatcacgcccggctaatttttgtattttcagtagagatggggtttcaccatgttagacaggctggtctcgaactcctggcctcaagtgatctgcctgccccagcctcccaaagattacaggcatgagccaccgcacccggccaagtagcactcctttgaaggtaatctgcttcccctacccctagcaatttttaacaatttttcttcatttttatttcctgaagttttgttattaataatctgtgtgcagatttctttgtatttcttttgtttgcagttcatagtgattcttgaattagtgtgttggtttctgttatcaccacaggaaaattgtcagccgttagcttttcaaatatttccttgctaaattctctcttctcccctttcggtacaattgatttgattaaaactaaaaccagggccgggtgcagtgactcatgcctgtaatcccaacactttgagaggctgaggcaggtggatcacctaagctcaggagttcaagaccagcctggccaatatggtgaaaccccgtctctactaaaaatacaaaaattaccaggcatggtggcacacatttgtagtcaggaggctgaggcaggagaattgcttgaatccaggaggtggaggttgcagtgagctgagatcccaccactgcagtctggcctgggcgacagagtgagatgagaatctgtctcgaaaaaaaaagttatgaatgtttgataaactatatttgttagaatgtttgttgtagaatactattcattgatttttaaacaatgttagattaaaccattcactggatttgtgataattaacttactgattttacctcactgatttgttgtaattaatacaactggtataaaaagactgtgacgaggccgggcatggtggctcccgcctataatcccagcactttgggaggctgaggcaggcggatcacctgaggtcaggagttcaagaccagcctgaccaacatggtgaaaccccatctttactaaaaatacaaaattagccggtcgtggtggtgcatgcctgtaatcccagctcttcgggaggctgtggcaggagaatcacttgaacccgggaggtggaggttgcagtgagccgatatcgcgccattgcactccagcctgggcaacaagagcgaaactccgtctaaaaaaaaaaaagaaaaaaaacacataaaacaaaacaacactgtgacggttcccaaaaattaggagcataattaaaggaactcctgataaaaattaattttatcttacatgtaaactaaaatgactttatgaagttaattcagaaatacaatgcagggtattagtttgccacagctgcgtattcagcctaatgtaatattcttgttatttttaaattcttcttttaactttactcatatgtggatcatcaaatttcaaaagattaaatgacaatactcttagcagcaagcttccctaagcatataaacattttaatgggtgatgattcagaaggtacccgaagaatatgtactgccagatatcattcacccccatatacctgcccgacagacatcccattttgggaccctggataaatgtgtgggtggagagaaagataggagaaagtggtataagcaaatggctttggagtctgattgacagcgattgaaatcctgtctctacctcttaacagcctcatgatcctacataagttaccccgatcctcagggccacatctgtaaattgggggttgcgatggcagccatctcacagggtctcttttcggggaagggcaggaattatggattaagtgagctagtaattgtaaagcacttaatacaaggagggcgcataataagtacttcataaataatgacggccattatcatgactgaggtgtatgcagctgtcggggattacggcgacttcagaatttctggtgggcagggctcaaaggcagcaaatcacactggaagtcgaggtgaggcactgcttctgcacagactgcttagctggagagaatgaggaaggcttagaggagatttagaggaacttagagtcctccgcctccaactctgtgggatctgctcccgtgccagagacattcaggggatttctcgcactctcccctcccctacgtccctcccgccccatccaactaaccacacaacacatacaaaatagcccctgcgaggttctgcacgctggaagggaacaggagaagggcgctgcgctttcttgctgatgccctgtacttgggcccctggtagacacagccacttgtcccctcagcctgcagagaaatcccacgtagaccgcgcccgggtccttggcttcagccaatctccctttggtgggggtgggatgcacgatccaaggttttattggctacagacagcggggtgtggtccgccaagaacacagattggctcccgagggcatctcggatccctggtggggcgccgctcagcctcccggtgcaggcccggccgaggccaggaggaagcggccagaccgcgtccattcggcgccagctcactccggacgtccggagcctctgccagcgctgcttccgtccagtgcgcctggacgcgctgtccttaactggagaaaggcttcaccttgaaatccaggcttcatccctagttagcgtgtgaccttgagcagttgactttatttttcagtgcctagttttccagataccaggactgactccaaggactattactcatctggagggtttagcacagtaccgtcgcatagtaaatttccatgtcagttttggttacctttcatgcacttgcaaacatgccatgctctgaaacgaaataggcacatcttttttttttttttttttaaggagtcttcctctcgcccaggctggagtgcagtggcgcgatcttggctcactgcaacctccacctcccgtgttcgagattctcctgcctcagcctcctgattagctgggactacaggcatgccacgacgcccagttaatttttgtatttttagtagagacggggtttcgccatcttggccaggctggtctaactcctgacctcaggtgatctgactgcctcagcctctcaaagtgttgggattacaggcataagccactgcatctggccagaaatgaaataagtaaatcttttaacctgctctaacaatatagtgaaaagaccatattattattagagcaggttaagggatttgcctatttcgggttctagttatagtcttaaacttggacattcttgtagaaagtaaaaagtttcctcttcaaagttccccttcttgttaaagaatacatcataagtgttagaagtaatagtttattttaaagactaactttcttcaagcctccttgctttgtgctaataactctttgttaagccctatcctatgtaactgttggacatgctcacaggcacgttccagttcacagcctatgccccttccttatttggaaatgttattgcttccttaaacctttcggtaagcaacttcctctccttcttcgttcttccttgcacttacctatttagaaagttttaggctattagcaaatcggctatcagtttaagagtgtgaggtcccgctccagccaatggatgcaggacatagcagtgaggacgacccaaatgcgtaagggataaatatgtttgcttttcctttgttcaggtgtgctctcgacatcgttccatctgcgattgagcaccctttctgcagaaagtaaagattgccttgctggagatcttttgtctccgtgctgacttttcttcgtggcaccgattatctatttctaacaattttggtatttctaacattctgaacaatcttgggctagttgtctcttctgggcctgtttccccatccgtcacatgataaacttcattggtttaaaaaccccagcgaacatttattgagttactattaccttcctgccctccccaaccccaaccccagggagcagttacaacctcagccgctgagcgcactcgccgggtgttaagaagcaccaaagacagggaggcttgattgattttgctttgggagtagagggtcagaagattcacaggaaaatggcatttgagcaaggatgattcactggagctagcttttaaatactggcgaggcttttatgttgcagtcccttacaaagttgagcattcgcagggactgcactccgaaataagcccgcttccccttttcattcgctaatgatccagggagctgctggttccgcatgcggcaggttgtgccttttcctaatcagggttctgcatcgcctcgaacccgcaggccgtggcgggttctcctgaggaagcagggactggggtgcagggtgaagctgctcgtgccggccagcgcctgtgagcaaaactcaaacggaggagcaggaggggtcgagctggagcgtggcagggttgaccctgccttttagaagggcacaatttgaagggtacccaggggccggaagccggggacctaaggcccgccccgttccagctgctgggagggctcccgccccagggagttagttttgcagagactgggtctgcagcgctccaccgggggccggcgacagacgccacaaaacagctgcaggaacggtggctcgctccaggcacccagggcccgggaaagaggcgcgggtagcacgcgcgggtcacgtgggcgatgcgggcgtgcgcccctgcacccgcgggagggggatggggaaaaggggcggggccggcgcttgacctcccgtgaagcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaaggtagctgagggggcgccggcggggagtcaggccgggcctcaggggcggcggtggggcaggtgggcctgcgagggctttccccaaggcggcagcaaggccttcagcgagcctcgacctcggcgcagatgccccctgagtgccttgctctgctccgggactcttctgggagggagaaggtggccttcttgcgcgaggtcagaggagtattgtcgcgctggttcagaagcgattgctaaagcccatagaagttcctgcctgtttggttaagaacagttcttaggtgggggttagtttttttgtgtttctttgaggaccgtggatcaagatcaaggaaatctctttagaaccttattatggaagtctgaagtttccaaatgttgagggttttatgtctaaaagcaacacgtgaaaaaattgttttcttcacccagtgctgtcttccaatttcctctttggggggaggggtagttactgctgttactaaaataaaattacttattgctaaagttccccaacaggaagaccactacttttgatgactttggcaagtttgctaactactggaaccctaacttacaaacgaactacttacatttttgatttccagttgtattacctgcccaatgtttacgtagaaacagcttaattttgattctgggtaacgttgttgcacttcattaaaaatacatatccgaagtgagcaagtatgggtctgtggacagcagtgatttttcctgtcaattcctgttgcttcagataaaatgtaccagacagaggccgggcgcggtggctcacgcctgtaatcccagcactttgggaggcttggcgggtggatcacctgagatcgggagttcaagaccagcctgaccaacatggagaaaccccgtgtctactaaaaatacaaaattagccagggtggtggcgcatgcctgtaatgccagctacttgggaggctgaagcaggagaatcgcttgaacctgggaggcggaggttgcggtgagccgagatagcaccattgcactccagcctgggcaaaaagagcgaaactccgtctcaaaaaaaaagtaccagacagaaatgggttttgttttctttttttgttttgagacggagtttcgctcttgttgcccaggctcgagtgcaatggcgcgatctcagtctcggctcactgcaacctctgtctcccaggtttaatcgattctcctgcctcagcctcccaagtagctgggattacccatgccccaccatgcccggctaatttttgtatttttagtagaaacggggcttcaccatgttaggctggtcttgaacccctgacctcaagtgggcctcccacctcggcctcccaaagtgccaggattacaggcatgagccaccgcggccagccagaaatgggttttggaaaaagcactaaacaaaatcgaacttggtttcatatgacagctctgctgctaactgtaacaggggcagaccagttaacctacttttctgtcttctgtcagctgagaattagatgattcccaaaggcccattgaactctgaatgactttaaatacttcttcttaagtgggtacacggttttggtaactgatgccaggtgatgaatgcatgaaagtgcttaatgaatgaaaccggtaaaatagtaggaggaagctttattggtaaggcaggggtatacctaatagctctctaatttattggtattgaagtggttaacttttgtttttttaaggggggaaaacattctaagaataatgaggcaaactgcatattgcacaagagactgttgtctctattcaacaaataccttttgagtgtccagagtctgccaggtgctgtgctaggccctcacgattgagtagtgaaccagagaatgtccctgcacccatggagcttattgtctactggggtagacagataataaataagcaaacaaatcttctctcttctccctttcgctccatgtaagtgtgtgtgtataggtgtatacttacaagttgagtaaagtgttatgaaagattaagaggagaaatgcattttggttagatgttagaggactcagcaggtgaccttgaaacttagagctgaaggatcagtaggaggtaactagagaggccagggaatcgcatgttcaaaggccaggaggcaagaaagagcatggtgcccttcaagagaggaaagaaggctactgtgactggagcatagatgtaggcaagtgttgggtgattgagagctctacgggccatggttaggttttattcctaatgccgagatgccaaacatggtggttcatatctgtaatcccagtattttaggaggccgaggcaggaatatagcttgaacccaggagttcaagaccagcctgagcaacatgagacctgtacaaaacatttaaaaaattgctgggtatgatggtgcacacctgtggtcccagctactcaggaggctgaggcagaaggatcacttgagcctaggaggtggaggctacaatgagccatatttgagtcactacactccagcctggatgacaaagtgagaccatgtgtcaaacaaaatacagaaagaatattaatttaaaattttgaaagaggagtgatctgaacttatatcttaaaaagatcattctagggcatggtggctcatgcctgtaatcaagggctttgggaggctgagacaggaggatcacctgaggccagttcgagatcaacctgtacagcatagagagactccatctctacaaaaagaaaaaataaatagctgggtgttgtgagttattcaggaggctgaagcagaaagatcacttgagcccaggagtttgaggctgcagtaagctatgatcccaccactgcaacacagtgagatcttgtctcaaaaaaaaaaaaaaatcattctaggtgctttttggaggctggatgtggtaagagtagaagctggagatggtcctgttagggattcgattcagactttaaataccatcaatgcattgagtcccaaatttacatcactacgttggatccttgcccctgaatccagactggtatatccaactttaggttcagtttgtatctctacctgaccaatatagaggtgtccagtcttttggcttccctaggccacattggaagaagaattgtcttgagccacacatagagtacactaacgctaacaatagcagatgagctaaaaaaaaatcgcaaaacttataatgttttaagaaagtttacgaatttgtgttgggcacattcagagccatcctgggccgcgggatggacaagcttaatccagtagataccttcaacttacaatatctaaaattttatgccagatttagtcattttaaacctgctcatcagtttttctcaagaagtagtattttggctttttttcttttcttttttttgagatggagtttcgctcttatcgttcaagctggagtgcagtggcggatcttggctcactgcaacctccgcctcctgggttcaagtgattctcctgcctcagcctcgcaagtagctggaattacaggcatgcgccaccatgaccagctaatttttggagacagggtttcaccatgttggtcaggctggttttgtactcctgacctcaggtgatctgcctgcctcggcctcccaaaggctgggattacaggcatgagccaccgctcccggctgcatttttggatttttagttgctcagcccaaaactttagtacatctttgaacctcttctttcctcctactctatatctgatccatcagcaaatctgttaggtctacctcacacatatcgaaatcctaccacgtctcaccatctgtgacaattaacaccctggtctaggcagtcatctctgttaagattgagtggttaaggatgtcctctaaggagatgacattcaaatcttagcttaaatgtcaagagggagctggttttataaagattgaggaggcagcattattttgccataggcttccatttggtttccattccattcttgatacttatggtatatattcaaaacaaatgcacagaaacagacccaggtatattgggaatttcggatatagagttcctagttgggaaaagatagactgatctgtaaatgatgctagttatccatcatctggcaaaaaataatttcctgcctcctctcatatatctcagatcaacagactttttctgttaagggccaaatcataaatattttaggctttccagaccatatggtttctgtcacactctcctttatccttgaagccatagacaatatgtaaacaaatgggcatggctgtgctacgataaaactttacttacaaaaactggtagtgggccagtttaggcatggccagcactttgggaggctaaggcagatggatcacttggggtcaggagtttgagaccagcctggccaacatggtgaaaccctgtctctactaaaaatacaaaaaatagctgggcatggtggtgggtgtctataattccagctactctggaggctaagacacaagaatcacttgaacccaggaggcagaggttgcagtgagctgagatagcaccactgcactccagccagggtgacggagtcttaaagcaaaacaaaacaaaaggtagtgggttgtatttggcccatgggctgtagtttgccaatccctgatgcagaaacaaattccaggtaaataagagcctggaatgttaaaaaaacaaaacttgaagtcatgtagaagaacaggtagggggaacaatcctgatctcaggataggaagggatattgcttaaaataagacacaggaaaatataatccatgttgtgtaaatttgactacgttaaaacttaaaactttcgccaagcgcggtggctcacgcctgtaataccagtactttgggaggccgaggtgagcagatcaccaggtcaggagattgagaccatcctggctaacacggtgaaaccccgtctctactaaaaatacaaaacattagccgggcgtggtggcgggcgcctgtagtcccagctacttgggaggctgaggcaggagaatggcctgaacccgggaggcgaagcttgcagtgagctgagatcgcgccactgcactccagcctgggcgacagagtgagattccgtctcaaaaaaacaaaacaaaacaaagcaaaaaacctaaaactttcatacaataaagtatacctaagatacttctagaagagaagatttacatccaggacgtgtatggaatttctgcaagtaataagtaaaagacaagggacatgaagaggcagttcacaaaagaggaagccaaaatgaccaataaacatgaaaggatgtttaacctcaaaggaaacaaggaaatgaattaaaaacatcaaatgccatttcaaaactagtaagttggcaaaattaaaaataccaaggatgagaatatgaagcatggctatatgagtgcatggaatggtacagtcactttcattaaaaatgcacataatttgttttttatttatttttttgagacagtctatgtcgcccaggctagaatgcagtggcatgatctcggctcaccacaatctctgcctcctgggttcaagcaattctcctgcctcagcctcctgagtagctgggattacaggcacatgccacaacgcccggttaagttttgtatttttagtagagacagggttttgccatgttggccaggctggtctcgaactcctgacctcaggtgagctgcttcccaaagtgctgggattagaggcgtgagccaatgctcctggctgaaaaaaatgcacataatttgttacctagcaattccatgtctagaggcttatcctagagaaattcttgcttatatgcataggaagacgtgtactagaatgttcactagttgaatgtttaagtgaaaattaggaaataaagtaaatgttcattaacaggaaaatgagtaaaggtatatttataaaacaattaagtagctaaaatgaataaactagagctgcgtgaatgaactagaactggttcaatagtcatgtcagattattgaatgaatacaggtcagatatgtatagagtgtcatttgtgtaattaattttttttttttttttgagatggagtctcactctgttgcccaggctggagtgcagtggcgtgatctcagctcactgcaacctccacctcctgggttaaagtgattctcctgcctcagcctcccgagtagttgggattacaggcatgcaccaccatgcccagctcattttcctatttttagtggccacagggtttcaccatgttggccaggctggtcttgaactcctgacctcaagtgttccacccaacttggcctcccaaagtgctaggattacaggcgtgagccaccgtgctcagccatttgcgtgatttttaaagatgtgcagaataatgccattaaaaaaaatacacatacatgtatatatatacacgtttggctgggtgtggtggctcacacctgtaatcccagcactttgggaggctgaggcaggaggatcacttgagcccaggtgtacaagactagcctgggcgagatagcaagaccccatctcaacaacagaaaggataattaggtatggtggcatgagaggatcacttgagcccaggagttcgagtgttatcaggccactgcactctagcctggacaacaaagcaagaccgtgtctcaaaaaaataaaaataaaaagtatttgtatgtggtcatagtcaaaaaacgtacatggaaggaaaatgtctttatttatttatttatttttttttttttaagacagagtcttgctctgtcacccaggctggggtacagtggtgtaatctcagctcaccgcaatctcggcctcccgggttcaagcgattcttctgcctcagccttctaagtagctgggactacaggtacccgccaccacaccctgctaattcttgtgttttcagtagagacagggtttcaccatgttggcaaggctggtctcgaactcctgaccttaagtgagccacccgccttggcctcccaaagtcctgggattacaggtgtgagccactgcgcttggccaggaaatatctaatttagtaagtatttatatctgggaaaggaagggtcaggtggtgattcataggaactctaaagtctatgtataatacttagggggacagaaggaaataaagcaaaatgctgatatttgattgttgagttgtgtatatgttagaagtataacataggagatctgattgatagtaggagaatgtttttaggtggtaaaagtggaaccgtggtggtttgttttggcagtagaatcagttggtcatagtttgtatgtggaaggtaataaacagaccatgttaaggatgacttccggaattttggtctgagtagtgggtggatgacagtgtcattcatgagggaagatgaagactgaggtaggaacaggtttgggagaagatgacatgttcccttttagacaagtggaattatggaagatggcaggtaggtggttagctatatgaatttgagataaaagatttaggatggagatataaatttaggagtaacagcgtatctatggtattgtaagccttaagaatgggtaggatcagccaggaaatacagatgtatatgcagaagagaggagtcaaggaagccaagacaagttaatgtttaaagtgagtgatgtagtccatgggcagatgctgctgagagggctgcaaacaccagtgaccctacaacatttttaaatgtcgtcttcctgacagcagtgatcagtacctgcaacgatcttatttatttttttcatgttagtctccacacacttgaatgtagactttttgaaggcaaaatcattgccttttctgagctgggagcatgtctggcacataccaagcactcaacagttgatgtattgacttcatccagatactctgagggcgagttatttcctgctactagcctttcacctttcaatgtttaagagcacaaatacagagatgggcacgttttggcatttcttattttgataaccttttcctggtaagattttttaatgttgaaaaaaaaaaacaagaaaagagggttaaaaatagtcttatgtcagatcctgtgatagaattcacacttggcttaagctgctgggcaccttcctatcttggatgtcatattagcttatctacagcagaatttttactgttttatgtagtaaggaagcaattatatgattattttacagacaaattattctttatcttttatttttttagacggagtctctctttgtctcccaggctggagtacagtgtcgcgatctcggctcactgcaacctccgcctcctgggttcaagcaattctctgcctcagcctcccaagtagctgggcttacaggtgtccgccaccacacccagctcattgttttgtatttttagtagagatggggtttcaccatgttggccaggctggtcttgagctactgacctcaggtgatccacccgccttggcatcccaaagtgctggaattacaggcgtgagccaccgtgcctggcccagacaaattattatactctgagtgttagaggcttaggatgttttcacttgatgctatgggaggaataagtaataagatatgatacacaaccaaagacctttcttcactatgcttctagtagctagtactatggatgacacatggtaataatattggttagcatttgtcctcaatttactgtgctagttactcttctaagccccttacaggtatatattttttttcatcaataatcctctaaggtagtttttattattgacctaattttataaatcaagaaaattaagacccagagaagtaagtaacttgtccaagatcacatggcttataagtggtagagccagaatttgaccccagatgttgtgactacattgtctctccataagcaggttcaactcttttgactggatgctgttccaaggtcacttccttagagaagcctttgctgacaactaccctcctgtgccctcctccaaggctgtccattgttctagaactttgaatactcatcttagaataaagctggtctaatttttacagtgttatagaatggatctctgactgcaaaagttggtcataattatctttttatgttctagtgaaaggcaaagaacaagagaagacctcagatgtgaagtccattaaaggtaagttctgcccttggcagtccactgcattaaaaagtgatgtgctttgcatttgtgagttctttaatcctgttatactctctcttttggcattaatcatttctgccttattttataattacttatgattttgatttatttccctctttaacctgtataatgctttaacatctagcatataataagtaggctttttttttttttttttttttggagacggagtcttgctctgttacccaggctggagtgcagtggcgcgatcttggctcactgcaagctctgtctcccgggttcacaccattctcctgcctcagcctccccagcagctgggactacaggtgcacggcgccacgcctggctaattttttgtattttttagtagagacagagtttcaccatgttagccagtatggtctcgatctcctgaccttgtgatccgcccgcctcggcctcccaaagtgctgggattacaagcgtgagccaccgcacccggccgtaagtaggctttttttaccttaattttatttttttgagatggagtcttgctcttatccccaggctggagtgcagtggtgccatctcggctcactgcagcatccacctcccgggttcaagcgattctcctgcctcagcctcccgagtagctgggattacaggtggccgccaccatgcccagctaatttttgtatttttagtagagacagggtttcaccgtgttggccaggccagtctcaaactcctgacctcaagtgatccactcgccttggcctcccaaagtcctgggattacaggcgtgagccaccatgcctggccataagtaggcttttactgagccttgtgtgtattggctatcctagtgattacagtgaaccagtgcccttcttattaatcacacatttaattgttccctaaaagtgattagttcactttatttatttagtaagacaaaaaatgaagaatactcttaactgagcagtctgttaactgtaggaaagcactgacacttataaggcttagttttctgtcatttatccagaagtatggttgattacagtttttacttttttatttgaatgaacaaccttaatttaaaatatattttgtttattttttgttgggatcgatacattgtccttgtttatagattagagcatgctttttaaagatgctgtattactcactgattttatttgtccagtgtacagagattgaagtgggaaaattataatggaaattgtttccatagtcattacatattaatttcatcaatttatttccataaaatctgtagattgctacttatttagatttttccttcaaatgtttttatgttgtattgcttgcactgagtatttattctatatgctcaatttgctggagaagaagactaattataacttaggcaagttgtaaaattagggaaaaaagtaaggtaccttacagcctagtttacttatttcttatgtaaagccagttagattccacattagttcaaactgccttctttgagcaaaacttgattggcagtgataaaggcttaaagcccttctcaagcagagacctgtaaagactagatctgactgtagtagaaggaaggaacttagatgtttcaggcagtgagaacaccagtcttccactctaaactttgccactaacagtatgaccttgggaagttgtaactttcttcagattcttcatttgttgaatggggggattggcctagctaatttctaaatctctactgggctaaaaaattctgtgcttatactctgattatgaagtacataatctgtgcttaacattcactgacttatccttaggataatacagaagcagtacaagaaacagcccctcaagatgtttgcagtctggttagaaagacaaacttatacacagaacagtagcaaatagaccaaaataataatagctgccatttatagaacacttcttctgttctgggcattagacaaaaactgactataacggtgaacaaaaaagacttaggtcctgccctcattgaacttacagattagtaggggagaggaacattaatcaagtaattccacagatggcttagcctagattggtagtgatggaagtaaagagatgtgaacggacttgaaaaaaaattcggaggcaaaatggatagaagtttattattgattaaatatgaggtgtgagagagagggatatttaagattgatacctaccttctggcttgcctaacagaaccaaaacaggaaattatatgttcagttttgttatgttgggtgggaggtgcttttgagtcattcatttatatatgttatatatgttattttatatgcatagtaattttaaggtctgagttttaaaccaaaggttagagagtgattttttagagtctagcaaacctaagttgaaatcctgcctgttgaaatggctgtttactagctcattaacctagggcaaagtattcaacttgttttcatttttgtcttcatctctaaaatgaggaaaatatggtcttacaagattgtcctgagagatagatgaaataatatccaaaaaaaaaaaaggtacatagagaaactcgtatagtgcctggtatatagtaggtcctccattggtagctatcattatctagttttaacatagccttcagtttgttgaattagtcaaactgagtgaagcactgcaaggaattcagaggaatttgagatcaacaaatgatttctgaagtttagggaagacttcatggcaatgacacttaccttgtataaaagttgaagaataagaaagatttgaatgagagattctttctcttctccctaccagcccagcttcttatttgaggatatattgggcaaaggggccttcagacaagtagagggagatttttacagaaagattgagatgaaggtatagaaggctgtaaagaccagaaaagagaattgagacagaggaagcaggaagccactgtaggtttttgagcaagatattgatgctgtaagtatggtgtttatgaaaggttagtctggaagagatttgcaggatggagaccccggaagtttttttgttataatacagaaagacttgcactgagggtgaggtgttaaaaataaacaggtaagtaaatgtttaaacatcttgaaggaaaagtcaacaaatcttggcaagtaaacagataacagtgaaaaagaatgggaccaagattttgagttttggagactggtggattgaacagacagggaaattgagaggagaatcagatgatgatgttttaagttgatatttagacagattgtgcttgagatggtaaagtcaatgtgggtgggaatgcttagtagcgagtaatcagtgatacaagaccaaagcccaggtcaaagacaagtcacagatacagatcagggctttttcatctgctccacagaggtgtaccctaggagctgttgcaaacagtccatgtggagggtgtgagtaagatgtttcccttgaatttgccagaattacttttttgttgttgttgttgttttttctgagacagattctcgctctgttgcccaggctggagggcagtggcgagatcgcgcagctcactgcaacctctgcctctcgggttcgagtgattctcctgcctcagcctcccaagtagctgggattacaggcttgtgccaccaagcccagctaatttcttttgtatttttagtagagatggggtttcaccatgttggccagactggtctcgaactcctggcctcgtgatctgcctgcctcagcctccaaaagttctgggattacaggcgtgaaccactgcacccggtcccttgttaagtttattttggtgggaagcaaaggaggtttcagcttttaaaaagtttgaaaattattgctctggtaataattaaagatttgagagtaaatatgctttctagcagaaagaataaaagaagaacagatagcctcaagaaggggagccaaagaagcaggctatatctgacacactgggtgttgataaatgggtattaaaagaatgagagcaatgagcagatagaagaggaaattaggagagtataataccatggagaccaagaaagatagactatcaggaaggagtggtaaaaataagttactagttctaagagagatgttaagagggaccggggaaagccttgtacaaatgagttagtagcattttacattatatacatctaattaagaaacaatgcgagagtctcaccattcctatagactcttacttgtacttgtctgaacacgaaaactggcttttgtttataaataagctaaaaattattttgctccaatttctcatgaaaataaaaataaaccttcttttaacattgaaaaaatagtttgaagacagtcactcttcattttgtaattcccacaactattattgaatgactgaaattatctttattctgaagccaaaggggtgatactgatatttcttcagactactaaaaatatattttatgaatttttagtgtgctttatctttttttgtttttttttttgagatggagtttcactcccgttgctcaggctggagggcagtggtgcaatctcagctcactgcaaccttcgcctcccagattcaagcaattctcctgcctcggtctcccaagtagctgggattacaggcacctgcccccacacccagctaattttttgtatttttagtagagacagggtttcaccatgttggtcaggctggtcttgaactcctgacctcaggtgatccacccaccttggcctcccaaagtactgcgattgcaggcatgagccaccatgcctggcctgaggaatatttttctaggttccccccaccccaagcatttattctgcaattttagttttgttcctaaagcaagcaaggtttaaggatttaaaaataatccgtattttagaatgctttctggctttgttactttttatccacagtagaagttctcagagaatgatctccctcttttaatttaactttttggcacagtattttgagaattataaataatattagaatgttttctggctgggtgtggtggctcatgcctgtaatcctggctacttgggaggctgaggcaggagaatcacttgaacatgggaggcagaggttgcagtgagccgaggtcatgccactgcactccagcctgggtgacagagcaagactctgtctgggaaaaaaaaaaaaaaaaaaaagagtgttttctttcctattttccaccacttgattaagttacttttcctcttaagtattttttgctgagtatgctgacttaagagtaatgttacaaaatttaatttttaaagttctctgaaagcccctttatgagagttttaggctatcaaattgtgtttaattcttaacaattttttgaaaaattatagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggtaagtaactatcattttttattaacttgtattagaaggatttgagtacaatatgtgaaacttctgtcataggatacagaactatataattggaaagtgctttggaaaaaatgtatttaaaataacagctacaagtataatgggtagctgtgttgtgttcctgtaaatatagaatataaagcatgcccagtagaaaaacaagcatttccagaagaaatatatctgatcactaaatataaatatatgaaaaagatgtctcactttattactgagggaagtgcaaattaaaataatcagttaatgttctcctaacacattagcatattttttaaagtttgacaatttgaatgtcagtgaagatgcagggaaatacccctcctatttagtgataatataatctggtgaagactctttggaaagcaatttggaaatcagtataaaatatgcatgtcatttaggccactctttctaagacctagccctcagatatgctcattcatatgtgcaggtgtgtatgtgtgtgtgtgtgtgtgtgtgtgtgtgtatatgtatgtatgtatgtatgtatgtatgtatgttgaaggctattcattatagtattgtttgtgatagcaaaaaattatggacaacatataaatatctgttatagggaaataaccaaattgtggtatacgcatgctctggagtataatatagccatttgtttctatttatttattttcttgagacagggttttactctgttgcccaggctggagtgcagtggtatgatcatggttcactgcagccttcacctcctgggcacaagccattctctcgcctcagcctccagagttactaggactgcaggcatgtgtcaccacacccagataattttttaattttttgtagagacagggtctcactatgttgcctaagctggtctcaaactcctggcctcaagcaattctcccacacaggcctcccaaagtgctgggattaccaacgtgaaccaccacacctggttcagtgtagccatttagaaatctaaaaaagacgtgggaaaatgtctaaggcatgtttaaatgtgagaaaagcaagtcacagtatgcatggtaaaatccgttatattaaaataagttcttccaaaacaaaaacatatgcaggagacctttattttgtcagtatttcttacccaaatttctgcacttagaaaattgcatgtcatgttgtcataagttgaaaaaaagatccatgaaccaatggacttctaataaaatcagtcctgcttttgacatctctctctacttttgtgtatattcaaaccagagtgtcaatgtgtttgtggggcacacttagcaataatacatagcagacaaaatgcatatagctcagagagtaaaattgtaagttttgctagatcactcataaattgctgatgagaatttaaaatggtgcagatgctctggaaaacaggcagtttctttctttctttttttttttctttttgagacagggtctcactctgttgcgcaggctggagtacagtggcgtgattacaactcactgcagcctcaccctcctcaggttcaggtgatcctccctcagtctcctgagtagctgggactataggcatgcaccaccacgcctggctaatttttgtattttttttttttttttttgtagagacggggtttcgccatgtttcccaggctggtctcaaactcctggaatcaagcgatccacttgcgtaggcctcccaaagtgctgggattacgggcgtgagctactgtgcctggcctaggcagtttgtttgtttgtttgtttgtttgtttatttatttgtagacggagtctcacaggctggagtgcagtggcccaatttttggctcactgcaacctccgcctcccaggttcaagctattctcctgcctcagcctcctgagtagctgggatgacaggtgcctgccataatgcctggctgatttttgtatatttagtagatatggggtttcaccatgttggtcaggctggttttgaactcctgacctcaggtgatcagcccgcctcggcctcccaaagtgctgggattacaggcatgagccgtcatccctggctggtggtttcttatgacgtgaaacatgcaattaccatatgacctagcagttgcactctgtatttatcccagataaatgaaaacttaccttccaataaaaacctgtgcacaaatgttcatagcagcttaatattgaaaaactggatgttcttcagcaggtgaatgaactggttcattcataccatggaataccattcagcaataaaaaggaacaaactgttgatacatttaaccacctggatgaatatcaagggaattatgctgtcagacaaaaaccagtccctaaagactacatatagtatgattccgtttggataatattcttgaaatagagaaattaagagaaatgaaaagattagtgtttgccagatgttagagacagggaggtgagaggggtaagtgggtgtagttataaaagtgcaacatgagggatctttgtgatgttgaagttgtatcttggcagtggatgcagaaatctcaatgtgataaaattacaaagaactaaaaacaagaatgagtatagataaaactggggaaatctgaacaagttagagtgttgtatcactgtcagtatcttagagtgatattgtactatagctttgcaagatgttaccatgggagaaactaaagtgtacaagggatctctaggtattattatttttttagagatggggtttcactatgttccccaggccggtcttgaactcctgggctctagtgatccgcctgccccagcctcctaaagtactggaattacaggcgtgagcgaccatgcctggccctttcagtattgtatcttagaacttcatgtgaatctagcattatctcatagaatttaattaaaagaaattgtaaacctcacagaagatcagaatttcctcaagtttgtgatgttgacaaagatgaactagttgacactgacagtaagactgaggatgaagacacgacgtgcttcaaaaaaatgatttgaatatcaatggattaagaagaactcttttgacaaattgatgaaaccctcagtcagttttataagaatgcccatctttatgatcatgctatgaaagccaatttttaaaaaaattttttgtctttcctaacaattagcttgtggttataatttaaatttagttaaatataagataaatgattttttattaagtttagtttcatttttcaaggtacgatctcaaagctactctttaacctactatgaatgaataatgctgagttcataacatctttgtagatatatccacaattttccctcaggataagtgcctacaagtggaattactggactgaaaataatgcagtttgctaagactttgctatctgttcctgaatgctcctccaaaaaggttttgccagtttacatcctcatgaccagcgaatgagagtgttgcctattttcctgtgcccttgttactgcttaataatttttgaaaaaaatctaatttgacagacaaaaatgcattttatgttaatttgcttttctgggatttttaatgaggttgagtatagtttttaatatttttattggcccctttggaactagtatcataagttttttttcttaagaatttatgtagtctgggctgggcgcagtggctcacgcctgcaatcccagcactttgggaggccgaggtgggtggattgccgaaggtcaggagtttgagaccatcctgaccaacatggtgaaaccgaatctctactaaaagtacaaaaactagctcagcgtggtggcgggtgcctgtaatcccagctacttaggaggctgagtcaagagaatcgcttgaacccgggaggtggaggttggttgcattgagccgagatcgcgccattgctctccagcctaggcaacaagagtgaaaagtctcaaaaaaaaaaaaaaaaaaaaaaaaaagaatttacatggtctgaattgccattaaaagagatatgagaattattgagtaacaaataactttttaataatttaggcaagttttggacgattgtactttgtttagaaaccaaaagcatagtatttgtagtttttttatttactttagttgctaggaagtaaactttattcaaggtctctggtaccagttgttgctaaaagtgattgactaatctgtcaatctgaaattatttgttgctgaactgctaattcttttgcttctatcttttaggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtgagtatgtgattttcttgtgtgtacatatgtgtctcactttctttttttaatttactaagcagaacttcagatgaggaataaaatgattggaatattttttttctcctctaactacttgtaaatttgggagaatttggagagtgtagtagagtcagatcagtgtatggaaaaggagcaggagtgactggaccttctaagaagtgtgttatcagaattagtaaatgaagggtcaaatgtcctacttttcccctccactgattttgacatcaaaccattatccacatagccttatttcctccctcggtcttaattttattaatattttactgcactttgcagataaaatttttaaaaaatttttaaaaattgccaataagtgacatttattaagttcagtgcttagtgtatatttggattttatttattagtcacaagacctttgtgcaggtagtaggcatgattatctttttttttttgagatggagtcttgctctgtcgcccaggctggagtgcaatggcgcggtctcggctcactgcaacctccgggttcatgccattctcctgcctcagcctcccaaatagctgggactacaggcgcctgccaccacacccggctaatttttttgtatttttagtagagacggggtttcaccatgttcgccaggatggtctcgatctcctgactttgtgatccgcctgcctcggcctcccaaagtgctgggattacaggcatgagccaccgcgcccggactgattatcttatttacacatgagaaaaccagggcttagaaaggttaggtaacttcctctaggttgtacagtaaatgtggacctagaagcattttgacaagagcacctgtttttttttcttctctattagtttagaaattatatactcttaattatcacctgggattttgattagacagccttcatgttctttttcatcttaaatgttctttgtgtcttaaagggctaagtgatttcttcagatcttttagttcactcattctcagtgaactaaaatgaggtctaatctgctactgaatcaagttttcagcatgttatttccttcctccctccctccctccttccttccctcaaccaggctcccgaggagctgggattacaggcgcccgccaccactcctggctaatttttatattttagtagagacggggtttcaccatgttggtcaggctgatcttgaactcctgacctcaagtgacccacctgcctcggcctcccaaagtgctgggattacaggcatgaatcaccacacctgacggcatgttattttcatcgcaaagttactgtaagctgggagaagtggcacacacttgtactcccagctactcaggaagcttaaggtgagaagattgcttgagcccaggagttttgagaccaacctgggcaacacagcaagaccccagctcaaacaaagaaaaaaagttattgaattttttatttctatggatcattttttgtagtttcttattcctttcacccttcattcccacttttgatcccatcttttatttatttagttttattaaatgtatatttgtctgataattctgctatctacagttttttgtggacctgactcagcatttctttgtttcttcggattcagactgttggtggcttgtgattttagtgatttttggccgtgaacatgtttcttggacttttgtctgtgggaattctctgtgtactctgtataaattaagttacttcaggtgttttgcattttcttttgccatgcacctggggcctgggtcactacccttctggtaccacttaaaactgaatttttgtcttgggtgctcgtactgatcctgtatgagtacaggtttatacttactgtagaaatatggtgtttgattatggggtattgtcccagatggtgctggagtattaatatgctctctgttaaacttaatgtgttgtccctgtaaaactccaaaattctgaattccagaatactactggccccaaatgtttaagataagggcactgcctgtatttgtttctgcctcccactattttccttagtttaacacaaactcacctttttaaaaaacattttgagagaattcagtattgggaagagtttctaacctgtttctggaaatggaagtccaaagtctgtttctgtaattgttttttttttgagatggagtctcactctgtcacccaggctggagtgcaatgacgtactctcagctcactgcaacctccacctcccgggttcaagcgattctcttgcctcagccccctgagtagctgggattacaggtgcccaccaccatgcctggctgatttttgtatttttagaagagatggggtttcgccatgttggccaggctggtcttgaactcctgactttgtgatctgcccacctcagcctcccaaagtgctaggattatgtttctgtaattgtaatacatttattgtttttagaaactgtctttgctttagtggtaattttcaataaaaatagaaatagcagtggagttattaaaagagcattagttacatttttccctttttcattatcttcaaatattatatatagtaagtttgacctttttaaaatgtatacttgtatcagttttaacacatacatagattcctgtaactgtcaccactataagggtaaagaacagttagttccttcacctttgaagtcaagccccacctctatcccaacacttggcaaccgctgatctttctccgtctcaatagctttgccttttctctttttttttcttatttttttttttgagacagcgtcttgctctgtcgcccgagctggagtgcagtgaggcaatctcggctcactgcaacctccgcctcctgggttcaagcagttctcctgccttagcctccctagtagctgggattataggcacgcaccaccacacccggctgatttttttgtatttttagtagaaatggggtttcaccatgttggccaggctggtctcaaactcttgacctcaagtgatccacctgcctcggcctcccaaagtgctgggattacaggcgtgagccactgtgcccaatcaggactttttttttttaaatttacattcaacttgtcatttttttcttgtatggattgtgccttcagagtcacacctaagagccctttgcctaagcaaaggtcatgaagattttctcatatgtttccttttaaaagtattgtggttggccaggtgccatggcttatgcctgtaatctcagcactttgagaagctgaggtgggcagattacgaggtcaggagatcgagaccatcctggctaatgcggtgaaaccccatctctactaaaaatacaaaaaaaaaaaaaaattagccgggcgtggtggcgggcacctgtagtcccagctacttgagaggttgaggcaggagaatagtgtgaacccgggaggtggagcttgcagtgagccgagatcgcgccactgcactccagcctgggcaacacagtgagactccatctcaaaaaaaaaaaaaaagtattatggttttacactttacgtttagatatatatcttttttgagttaatgtcgtataagtatgagggttacgtcagattttttgttttttgtttatttttacatatggatgtctagttgttctaataccatttgttgaaaagacaacctttactccattgaattgcctttgtacttttgccatatttgtctaggcctgtttttggactcctttttctgtttcatgatgtgtgtgtctattcctttgttaataccacatggtcttaattactgtatagtaagtcttaaaattgggtaatgctggccttataaaacgaattgggaagtttttatttttactcttatttccattttctagaagagattgtgtagaattggtgtcatttcttctttagatatttggttgaattgggaagtgatgccatctgggcctagggttttgttttttgtgtgtgagacagagtctcacttctgtcacccaggttggagtgcagtggtgagatcttggcttactgcaacctctgcctcccaggttcaagttatcctcctgcctcagcctcccaaatagctgggattacaagcgtgtgccaccatgcccgactaatttttgtatttttaatgcagacagggtttcaccatgttagccaagctggtctcgaacttgtgacctcaagtgattagcccaccttggcctcccaaagtgttaggattatagatgtgagccaccgtgcctggcaggggcctagggttttctttttcagagtattttaaactatgaattcagattatttaatagatataggactatttaagttatctgtttcttcttgagtgaatttttactgtagtttatggcctttgagtaattaattgtattgaattgtcaaatttatgagcgtgtaattatttatagcatttcgggtttgtagtggtatccctcttttattcctggtgttggcaattgtgtcttgtttttctttgtcagattgtatagggatttattagtcttttcaaagaactagcttttgttttgatttttctgttgttttgttttcaattttattgattttctgctctttattatttcttttctattatttctgcttgctttgggtttattttactcttttttttttctccaagttgcttaaagtagaaacttagatttctggtttgagacctttcttttctaagataagcatttaatactgtaaatttccttctaaccactgctttagttacacccccacaaattctggtattttgaactgagcacaaatgaaatgttctaatttcccttgaatcttattcttttaccaatgaattatttagaaatatgttatttagtttgcaagcaattggagacttttttcctgttatttttctaccatttatttctcatttcattatattatggtcagagaatatattttgaatgatttcatttattaatttttaaaaataacattaaaaaattttttaaaatgtgaatataccacatacagtataaagattgtacattctgtttttggacagttttctataaatgtcaagttgatttagttggttaatgatggtgttcagtttttctttattcttgctgatactttgtatgcagttatatcactttattactcagaagagtgttgaactttccaactacaatttttttttccaattttactttcagctctatctggttttgcttcatgtattttgaggctctgttgttaggtgtgtacacattcaggatgatatcttctgggtgaattgcctgttttatcattatgtaattccctctttatggtaattttccttgttctaagatcagaaatatctgttgtccaatttatatagacactgcagctttcatttgattagtgcttgcatggcatatctttttccatttttttacttttgatctacctttataattctatttaaagggggcttcttgtaggcagcatatagttgggtagtgttatttatttatttatttatttatttatttatttatttattgagacagagttttgctcttgttgcccaagctggagtgcagtggtgcaatcctggcttaccacaacctccacctcctgggttgcagtgattctcctgcctcagcctcccaagtagctgggattacaggcacgcgcaccatgcctggctgattttttgtatttttagtagaaacggattttcaccatgttagccaggctcgtcttgaactcctgacctcaggtgatccacctgctttggcctcccaaagtgctgggattacaggcgtgagccactgcacccggctgagtcatgttatttttaatcttttctcacaatacagggtttttgttggtaaatttaattattttaatataaattttagtataattatttacattaaatgtaactgttgcactggggtatttataatgtgtaaatataattattggtattaatataattatattactcataataatattaatatctttggatttagattaccagtttagtatatgtttttctgtttctccctctttgatttccccttttttgctttttttttttttttaattcttatttttttttagtatttgttgatcattcttgggtgtttcttggagagggggatttggcagggtcataggacaatagttgagggaaggtcagcagataaacatgtgaacaaggtctctggttttcctagacagaggaccctgcggccttctgcagtgtttgtgtccctgggtacttgagattagggagtggtgatgactcttaacgagcatgctgccttcaagcatctgtttaacaaagcacatcttgcaccacccttaatccatttaaccctgagtggtaatagcacatgtttcagagagcagggggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaactgccatcgtcatcatggcccgttctcaatgagctgttgggtacacctcccagacggggtggcagctgggcagaggggctcctcacttcccagatggggcagccgggcagaggcgccccccacctcccagacggggcagtggccgggcggaggcgccccccacctccctcccggatggggcggctggccgggcgggggctgaccccccacctccctcccggacggggcggctggccgggcgggggctgaccccccacctccctcccagatggggcggctggccgggcgggggctgccccccacctccctcccggacggggcggctgccgggctgaggggctcctcacttcgcagaccgggcggctgccgggcggaggggctcctcacttctcagacggggcggccgggcagagacgctcctcacctcccagatggggtggcggtcgggcagagacactcctcagttcccagacggggtcgcggccgggcagaggcgctcctcccatcccagacggggcggcggggcagaggtggtccccacatctcagacgatgggctgccgggcagagacactcctcacttcctagacgggatggcagccgggaagaggtgctcctcacttcccagacggggcggccggtcagaggggctcctcacatcccagacgatgggcggctaggcagagacgctcctcacttcccggacggggtggcggccgggcagaggctgcaatctcggcactttgggaggccaaggcaggcggctgggaagtggaggttgtagggagctgagatcacgccactgcactccagcctgggcaacattgagcattgagtgagcgagactccgtctgcaatcctggcacctcgggaggccgaggcaggcagatcactcgcggtcaggagctggagaccagcccggccaacacagcgaaaccccgtctccaccaaaaaatgcaaaaaccagtcaggtgtggcggcgtgcgcctgcaatcccaggcactctgcaggctgaggcaggagaatcaggcagggaggttgcagtgagccgagatggcggcagtacagtccagcctcggctttcacaactttggtggcatcagagggagaccggggagagggagagggagacgagggagagccccttttttgctttcttttggattatttgaatttttccttaaatttatttatcttacttatttatttatttttttgagtgattctcctgccacagctcccaagtagctgggactgcaggcatgtgccactacacccagctaatttttttgtatttttagtagagacagggtttcaccatattggccaggctggtcttgaactcttgacctcaagtgatccacctgcctcggcctcccaaagtgctgggattacaggcgtgagccaccatgccctgcctttttctagaatttatatattgagttcttgattgtatctttttatgtaggctttttagtggcttctctaggaattacaatatacatacttttcacagtgtactcacatttaatattttgtaacttcaagtggaatgtagaaaacttaaccaccataaaaatagaactagggatgaggttaaaaaagagagagaaaagaaatgtaataaagatttaataacaccgtttttttttttttttctcttttttttttgagacagagtctctctttctgttaccaggctggagtgcagtggcgtgatcttggctcactgcaacctccgcctcctgggttcaagtgtttctcctgcctcagcctactgagtagctgggattacaggtgcgcgccaccatgcccagctaatttttgtatttttagtagagacggtttcactgtgttggccaggatggtctcgatttcttgaccttgtgattcgctctcctcagcctcccaaagtgctgggattacaggcgtgagccaccgcgcccggctaagtctttaaatatttttttgacattgcactttttctcttttccttctaggattttagtaacccaaatgttagttttgttattgtttggcaggttcctgaggctttccttacttctttaaatttttttttcctgttgttcagcttcgaaaatttctattcatctgtcttcaaattcactggttctttcccgttatttccattctgttattgagtctttgtagtgaattttaaattttgtttattatgttttttagttctaaaattttctttttttgtgtatgtcttatactttgctcctgaaactcttatttgtttcaggagtgatcttatttcttagagcatggttttagtagctacttaaaatttgttttatcatcccagcatatgtgtcctcttgattgtcttttctcttgtgagataatgggattttctggttctttatatgacaattaattttggattgtatcttggacagtttgacttacgttacatgattctgaatcttgtttaaatcctgtggaaaatattgaagtttttgctttaacaagcagttgacctagttaggttcagtccacaaattctaagcagcattctgtcggctctggttccatcatcagttcagttttgtatcttatctgcttatgtgcctttctgtgtccagtctgggacctggccaatggtcaggtcccaaagcctttgtacacttttagaagcagggccatgcacacccagctcacgagtggccccgggagtgcacatacaactcgacgttttcatgggctccttcttttctgtgatgtccctgacacgttctgccttctaagaacctccctttatccctttcctgttgtctggctagaaagtcagggctttagattccctatacttcagcacacttcctgtagctatgtcaacctctgtggccacgacttcttcttcttgggactgcagtttctcttgtcagaaagtaggattcttggagctgctgtcattgctgctgtggctgctctgatgctgcctgggagtcgaaggagagaaaggaacaaaacaaaacaacccaggggatttcctccactctctttgatccgtgagagccccctttcctgttcctcagaccagaaatagagggcctgtcttggaacttcttctttgtgcatctggtgtgcagtttcagcttttgagtccaggccaggaggtgctggacaaacttgtcaggagtacggaggtactgcaagttctgattacttttctcagtccacctgcttccaagtccttggatgcatttgtccattgttttgagttgcattccatgggagagacagaagagtgtgcttatttcatcttgacatacttattaggatttcatatcaaatcaacggatgatattctctatattaatttgctgttttccctttagcaagcacattaggaaaataacactttaacacccgcctttggtggtttctgtcataattattaatacttgactttttttttttttttgagacggagtctcactctgtcctttgaggcattgtccccataaacttttggtaaagcatcaataattttatctttcatccacacaagcttcaccataaatttgatgtttattcttccattttagcagaattcatgttgctccaataggggctgtcttcaaactgatgttttctccttcttagtgcctcagagtagatcctgttcagatacgttataacaggttaatatgagtttattttggtgtaaaagtactttgaaattcatgcatagttttttcatcatatgcattttccatagctttgaacacccccatgtaactctcctcttccacaaaccaaacaatgaaaaagcacctttgtgatggaagtttattttgcaataggaactcacagtgatctaagccctgctattcatgaatataattcattactggagtccaagttgctttttggtttttgaagttctcttcttcccttgcaggtatagaacaagatgcagtgaatacttttaccaaatatatatctccagatgctgctaaaccaataccaattacagaagcaatgagaaatgacatcataggtaagcagtgcttgaaactatggcaaaaaaaaaatgacaaaaaatgcacagaactgacaattttcgttattgactaagataattttttcttaacatggaatttagcagttcccttcctaatttgttttctgagtattttttatatcggattatagctcactttaaaagtttctcggctgcattcggtgcgagggtctttgcctgggccagatgggctgcagtgtagcgggtgctcaggcctgcccgctgctgagcagccgggccggcgggcggctacgctaaccggcacagaccaccggatggactggccggcagccccgcaccagtgcacgaagtgggcgggacagaaacttctggggttggaagtccagtgaggctaaaagccggtaccaaagtctctaggcatcagggctgcagcccaagagtctcacgaccagtgggcaactggatggccagacaggtgtctcagtggtggcctctccgtctcagggcttcatcccacttctcagtgggcctgacgtccctgggcaccctggatgtctacctgcattagccagagccatcacatggcctgtgacttgcctttttttgccagttgattgtgccacacacagtgtcatttctgtgtcatttggcacagctggaggtgcaaggaggagggcagcctcatgtccagtcccagtttcacgtaactttattcttctgaataaagacaatttgctaaccttaaaaaaaaaaaaaaaaaaaaagtttttcttatatgttggacccaaattcttaggctttaacctgaataacaatgacagcaagatcaataaatagtacacatttattaaacactcactgtgtcccagacaatattccaagcactttttatggatagactcattttaacttctaaagaactttgtgggataaatacagttattttatagatgaagaaactgaagcacagagaagttaagtgctttgtccagggtaacagctcagatatggcagagtcaggatttgaaactagaccctcacataccttaactgctgtgctgtggcagtgtttttcatactgtaggttgggaccagccttctcttatgccctcaccccctgccaaaaaaaaaaaaaaaaaaaaaaaatatatatatatatatatatatatatatatatatatataatatatatatatataaaatatatatatatataaaatatatgtattagtatatatgcatatatagtatatattatatattagtatatatactaatatataatatacatattagtgtgtgtatatatatatatactagaataaaaaaatcaaagtatctcagagtagtaaggacaaacatttcagaaaaatgttttcattatatatacatgtatgtatgtgtatgctgattcaacaaatatatttcttataggttatagcaaaatagtttgaaagcttttactgtgttttatcaggaagaccttaggtgaacgtatattcacagataaaagaggttatttattcattcaataaatattacattctcataagtcctaatattatgtatttttattcttcaaaaaagttagtatttgtgatttatgaaataagacatgttcttgcacttttagcagatctgtcccgatgttgggcttctttaatccttagtgtgggtgctttgcactcactcactgctggggacagcaagacccctgttagtctcagctgtgtttcttaaattggcccactgtaccttccagttagctattctggggtccatgtcatgttggctccattttccttttctttctcccacacagatacctataacggctataacataggcctggtggctgttggtggcttatccctatctgcttgtatttaaggggtactgtttcactgagttttgctgacagatgttgtcatgagatttgaggttttctgtgttgttgctctatttttatgtgggaatttgctactatcatcatccctagaccagcttttcctagtaatacaacagggatgttctgactgattagagtttgcctgtttgaagaattggttggctagtgatttttttttgaggggagtctgtaccagttaatagcctgactggcgtgtggataaaaaggaagcagtttcaagtcaaataaaacacttaaaatgaaaccacactgcaactctctttcttttacttaagcttaatcaaattaatgatgatgtaatcccatgaaggaaaagtcttctgaaggatcaagttgataacattttgtgatcaaagaatttgagaaaacctctatcccagtgtctatcattatatattttaggatgttaattacctgtgtggctttaggcaagtcatttttcctccttgagccccattcttaatcctgtccaaattatttgtctcctcttgcagttggactattttaatatagctgtccttcaagtgagttttgttcaaaggagccttcactttagctcttactgtgtacccactttgcatagtcttgttttaaatgtaatccttggatttttggtgttgctaactaattactgtttttatgtgaggatttagagtgatccagaatctatacttgcactacctccttcatcttccacaaatgtttgaagtggtagaatttttaaaaactttgaaggtacagctgacagaatttgctgatggtttggaagtgagtggtatgagagggaaaaaaaggaataaagcatgactgcattttttgtttgtttgtttgtttgtttttgagacggagtctcactctcgccaggctggagtgcagtggcgtgatcttggctcacggcaacctccgcctcctgggttcaagcgattcccctgcctcagcctcccaagtagctgggactacaggcgctcgccaccacgcctggctaatttttttttttgtattttagtagaaacggggtttcaccgtgttggccaggatggtctccatctcctgacctcatgatctactcaccttggcctcccaaagtgctgaggttacaggcatatatataagcatataaagtgtgttatagcatacaaacaggtatatatataaacatgcagtccacacagctgataggaatgaggcagtagtgaaggagaagttgatgtaggagaggggacagttgttacaggaaagaagtctggaggcagaagggatgaattccagtgctcacatagaagattgcttagatgggagcaaggacaatttatctagagtcacaggaaagaatgcagtacacgggtagagatgcaggtgagttgaaagatgtgagagatgatggaaataattttctgattgcttctatattctcaaggaagcaggaagcaaagtcctcagcaaagagaatagaagaggtgttaaatatttgagaaaggagatgtactgtagaaaaaaaaaaaactcagtttctccttctgaactctcacaaaacagaacccttccatgactctagttgtgtggggttttttccctgtcagctaccaattctgcagatgattgttcagtgaacaccaactgggtgtcctctaagtcagttcagttctcacactgtttacctggagatagcatcagatcccacagattgaggactctgtcccacaagactgcctccacttcagatgccagtctcaagtacaagttgtggcctgtgcttctgactgaccttctataaattggagttcccacagtcccctccttgggttcaataaatttgctagagcagctctcagaactcagggaaatgctttacatatatttacccatttattataaaggatattacaaaggatacagattgaacaggcagatggaagagatgcatgggcaaggtatgggagaggggcacagagcttccatgcactctccaggtcatgccaccctccaagaacctctacagatttagctattcagaagcccccctccccattctgtccttttgggttttttgtggagacttcattatataggcatgattgatcattggctattggtgatcagctcaaccttcagccccctcatcccgggaggttggtgggtagggctgaaagtcccaaacgtgtaattctgccttggtctttctggtgattagccctcatcctaaagctctttagaggccacagccacaagtcatctcattagccttcaaaagaatccagagattccatgaattttaggcgctgtatgctaagaaactggctaaaggccagttgcaatgtctcaggcctgtaatcccagcactttgggaggctgaggcaggaggatcgtttcaggccatgagatcaaaaccagcctggtcaacatagtgagacccccttacaaaaaatttaaaaattggccaggcgtaatagctcttgtctgtagtctcagctactcagaaggctgaggatcactgagccctggagttgaaggcagcagtgagccatgatcgtgccactgactccggcttgggtgacaaagtgagaccttgtctcagaagaaaaaggaaaaaaaaaaaactgggcaaagactaaataacatatttcacagtatcacagatttgtattgtctaggaaagtgaatgtaaacagaccaggacactagtatgatcccttggtttcatgaaggtcccactaaagtcatgaacacaaagtgagactaggcatcatgttatatggtttttccagccatgtttaacagctagctaaatagctaattgtttcgctgcagtttattttagcagttccttattttagcacatttcatgttttaaaatttctaccaataacattttaataaacttttttacagataacttcacaaatccataattttttaagttacaatcccagaaatagaattgctcattgaaagggtatgttcatttttaaagttatgctagaaactgccaaattgccttcagaaaaaggtgtttgtatccccactaacactagtgttagttttcttgtgcccttgctcaagtatacatattattaaaaacaatgttgggccagtttactagataaaaggtgtagtgcctccttattctaatctatttgattactagtgagtatgtatgtcttttcacgttggtcattttatgtttgttcctttgtggattgtcatgtcctttgctcatttttcttttggaacatttcttagtagtttataagagctcttggtattttaatgatagtaaccttttaactgtcatgcatgctgcaaatcttttttctgtttgtttgcctttgtattttgtttttggagggtttctatgtataggaattaaattttatgttgttaaatcttttgatttctgcttttgcatatgtacttcaaaagactttctattttaagatcaagtgttacctgtattttcttttagttctatttaaaacctcttaatttatatgcctgtgctgttaactcccaagttgattcacaagtgtgtatacatagtttgaatttagtggcaatttaattatttacaacttcttttgcagcaaggatttgtggagaagatggacaggtggatcccaactgtttcgttttggcacagtccatagtctttagtgcaatggagcaagagtaagttagttcatattttcacattgtgcatcctagggaatttgggttcattgttaggaatgggcttcactcagctaaaaacaaagtatttttgagaatttaaatattttggatatttacaagatcatataaagcatactctatcttggttaacagtttcttttaaatataaattatgtgaactcttaaaattttcattttcattttcaatgttaatatttcctaagttaaaataatttgtttttagttctgaaataatttggggagtgattgagtctgtagtgattatgactattagaattggtttatttatttaaataatgcatgtcttcagatggctctcctaatttgttagttaggctttaagctaaatggatgctatataactaaatccacatagatttgttgaaatggctccagaggttttttagatttattactgctatgtgcccttaaaaaaaatctattcattctttcacttaacatttatcagaagagtgctctgtgtaagacgtggttaggcatagtgccagtcttgaaggaagttacagcctaataaaagacatagggcatgttgtttggttactgtaatatgaagtggcatgtgttaaatgtcaggggagaactacaaagtcataaaaaggtgggagagattacatacaggtaaaggaatcaggaatgacaccatggggagtaaggtagtgttgacctaggcctttaagatacaatagggacagtatggaaagagtatatttttcccacttaaactctttccttggtcgttccctcaaattttcccttttgtccatgtgcaggcactttagtgagtttctgcgaagtcaccatttctgtaaataccagattgaagtgctgaccagtggaactgtttacctggctgacattctcttctgtgagtcagccctcttttatttctctgaggtaaagtctgcatttcttttcacactctattcgagcattccagcctctaactatcaatgctggggccctgtctataggaaataacacagaagagccaagtcatttccaaaaagatgtatcattgtttcaagttgtttctgatggcaagagtaatttaataatatattagagagaacatgaaaattcaatgtattaaataactctaattttgagaaacctaattaaactactgcatgtaagagagtgcatgtttttaattatttggagctattttaaaaccacagaatttgaaacttgcttccagtgcataaattgcagaccagacttcagaagagaaaaaaagtagtaaattttttcttatgctcatcatttttactttagtcacttgataggattgcccagtgaagaagcatttgcaacagacaatgagtatattaatctttttgaggcatacagtttagtataatgctctttgttaggcttcaacaagtgaaattattttgttggaaagcaaatgactattaagtagaaagaggattcccagtctcacaaagcagtaatttagacactcgattctgcctctttacaagaatacaggtactcagttgatttgttttctcactccctttctttgctataagtttaaatcaacaatttgtttaggttaatatgtcctcatggaatggtggaaatgatcagatataaaatatttggtttggttagtttactctttatatgtttgctggcaaggaaccacaaatccagtttagtataatttttactctagttcactaaaagtttgcatccagctgtgtaggtagtgtttgtttcttgttaacttttttttcgtctaaaagaatactttaaaacttttcaatctcaaatgactgtaacttgctgacaggtgttaacagaagaagtagatctttttgttttttgcttatgacctgtattttaatatttgagcttatagattagagattgtgagagaaatctgtttatagtcttattttcccttgtgtattttttcttcctagtacatggaaaaagaggatgcagtgaatatcttacaattctggttggcagcagataacttccagtctcagcttgctgccaaaaagggccaatatgatggacaggaggcacagaatgatgccatgattttatatgacaagtgagttatattgatagatggattcagcagatacttattgaacatttgatatgttttgtggaaataaagatgaataaactcagtctctgttgtcaaggagctcacaggaggcagcataaaagctgcttttatatggtgtttgtaaagctttgggggttcttagaacaaaagtttctgctgggaaaggggaggtgtatgtggggtaaacaggatggcaatggtggtgttcaaggagtgtttcccagaagagagattttgtttggatcccaaagaaagaagggaattttgctacccagagaaggcagaaaacaacattctaggcaaaggcattggcccagaagccatggaaacgtaggggaaagtggcactttcaagaaacttgagtttagataatcaaaggagtggggaataaatatgaggatgctggtactaattggaatagattgtaagggaccttgaatgcctatttatgggtatattatactttctgtataaatctgctcaggcacgttgttaattagttttttattagttttcactgaaaatgagaggatggaaacatcatacagtaaacaaaattgaaaatatctggtcaggcagatgatgagcttgtggccagctctgtaacgtatggtattcttttcatttaacttttcttactctgtaaaaaaagtaattcgtggtcgggcacggtggctcactcctgtaatcacaacactttgagaggcagaggcaggtgaatcgcttgagcccaggaatttgagaccagcctgggcaacatggcaaaacccgcctttactaaaaatacaaaaattagctgagcgtgatggcgtgcgcctgttgtcctagctacttaggggcctgaggcagaaggatcacctgagccttgggaggtcgaggctgcagtgagctgtgatccactgtactccaccctgggcagggcagtagagtgagaccctgtctccaaaaaaaaaaaaaacaacaaaggtaatttgttatttgtatccttaagcaaatgctaaaggggtaacttggggatagagaaaagtccacagatgttagggtttgaagacactaatagtatctaggccagtggttcctgaacattagtctgtgggctcttgctgggctgtctgcataggaatcacctgagagcttattaaaaataggttttcaggctggttgcggtggctcacgcctataatcccagcactttgggaggctgaggcaggcggattacttgaggtcaggcgttcaagaccagcctggccaacatggtaaaaccccgtctctactaaaaatacaagaattagccaggcatgatggcacacacctgtaatcccagctactcaggaggctgaggaaggagaattgctcgagcccgggaggtggaggttgcagtgagcggagatcatgccactgcactccaggctggctgacagagggagactctgtctcagaaaaaaaaaaaaaaataggttttcagtctgggtaccggtggctcacacctgtaatcccagcactttgggaggccaaggcaggcagatcacttgaggtcaggagtttgagaactgcctggccaacatagtgaaaccttgtctctactagaaactacaaaaaattaactgggcattttgacgggtgcctataatcccagctactagggaggctgaggcaggagaattgcttgaacccgggaggcagaggactgcatctcaaaaaaaaaaaaaaaaaaaaggtttccagtccccctgtctcagaaattctgattctgcaggtttgaggtgtgaccaggaatctttatttttagaagacataccagataattctgataaatagccagtttagggatgtagtctaattttcctattttgcaagtaaggaaaataaggcccagagaggtaatgattttctcaaagtcacagaacaagttagtggcagaatttggactggaatgcagttcttaatgttctgtccagtgtttattctggtacagtatgtttgtagaaggtattacgtaagaaacattgttatatagatgttgagataggaagagtttacatttagaaatttggtctaaaatgcctgaacattcaagtcgtggaggagtattgaccaacttactcaatacaacataggagattcacattttgttacaaaaatgctgatttaaaaggagagttttcttttttttcttcttttttattttttgagatggagtcttgctctgtcacccaggctagagtgcagtgacacgatctcagctcactgcaacctccacctcctgggttcaagcggttctcctgcctcagcctcctgagtagctgggattacaggtgggggccaccacgcccagctaatttttgtatttttagtagagacagggtttcaccatgttggccaggccggtcttgaactcctgacctcaagtgatccacccaccactgcctcccaaagtgctgggattataggcgtgagccactgtgcccagcctgcttgtttttgtatcatatatatgcatcatcataatcatgcattatcaacctttgtatttctgtcaggacatagaaaccattagagtgcttggaagagagcctttttttttttctcgcatttaatgctttttttggtattcatttcataatcagcttaccaaaacattacctgcattataccccatcaaggtagaaatctttgtgttatcaatattggttactccctttccacaccgagtcatcagtaagtcctgttctatccaaataggtcatatgcatctagctcacccctcagtgctgttttgttttgaatttgtacatgtttactcctgatgccttgtagttatgatgatgtgttcttattttattctgtgcatacaagttctcagctcgctttttagggaaaatgaccatgtcttcctttcctataaattcctttctatctatcaagtcctcaacagagaataggtacccataaatatgtgattgttagtttctttgcctcagttgtagtctgatccttacagcttttaaacaacagtagagttcaccgtcaagaactaaggatggttggcaggcagatagaaaggtagcaagttgacccaactatctctggggaagtgggaacaaagaaaggttacatcagcactgtcatcacatagctctatagttctaggcctgcaggctcaatcaagtagccttgtataagattctctggaggaggtgctgaaagttgcttatacttgctatggaatttgattttacttcggatatctttttaccataggtacttctccctccaagccacacatcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagtaaaaaagaaaaaagaaaaactaaaaagataaaagaataaccaagaacaaaacaaaaaaaattataatggagctgaaaaatctctgttgcctcatatttactgtactatacttttaatcattattttagagtgctccttctacttactaagaaaacagttaactgtaaaacagcttcagacaggtccttcaggaggtttccagaaggaggcattgttatcaaaggagatgacggctccatgcgtgttactgcccctgaagaccttccagtgggacaagatgtggaggtgaaagaaagtgttattgatgatcctgaccctgtgtaggcttaggctaatgtgggtgtttgtcttagtttttaacaaacaaatttaaaaagaaaaaaaaaattaaaaatagaaaaaagcttataaaataaggatataatgaaaatatttttgtacagctgtatatgtttgtgttttaagctgttatgacaacagagtcaaaaagctaaaaaaagtaaaacagttaaaaagttacagtaagctaatttattattaaagaaaaaaattttaaataaatttagtgtagcctaagtgtacagtgtaagtctacagtagtgtacaataatgtgctaggccttcacattcacttaccactcactcgctgactcacccagagcaacttccagtcttgcaagctccattcatggtaagtgccctatacagatgtaccattttttatcttttatactgtatttttactgtgccttttctgtatttgtgtttaaatacacaaattcttaccattgcaatagtggcctacgatattcattatagtaacatgtgatacaggtttgtagcccaaaagcaataggttgtaccatatagccaaggggtgtagtaggccataccatctaggtttgtataagtacactctgtgatgttagcacaatggcaagcagcctaacggaaattctgtttattgattgattgattgattgattgattgagacagagtttcactccattgtccaggctggagtgcagttgcacagtcttggcacactgcaacttctgcctcccaggttcaaccaattatcctgcctcatcctcccaagtagctgggattacaggcaggcaccaccatacctggctaatttttgtattttagtagagacagggtttcaccattttggccaggctgttctcgaactcctgaccttaagtgatctgcctgctttggcctccgaaagtgctgggattacaggcatgagctaccatgcctgggcagtaactgaaattctctaatgccattttccttatctgtaaagtgacgataatatgcacgtttacctcaaagttactttgatgattaaagtaaggtaatgtatataaaatacatattaacatagtacctgacacatggtaagcatcaaaaaatgttaactacttttattactattattattacgtatttttaaataattagagagcagtatcaaaaattagctgggcgtagtggcatgcacctatagttccagctactcaggaggctgaagctggaggattgcatgagcctgggaattaaaggctgcagtgagccgtgttcatgcccctgcactccagccttggtgacagagcaagaccctgtcttgaacaattaaagaaggcattatgccgcaacgttagcttagaaatgatccacatatatcaccagtaactgtcaacaggattggaaccctagttttgggtattatgatcacaaggtattattaatagcttattaataataaagcgttggctaggcacggcgactcacatctgtaatcccagcactttgggaggccgaggtgggtggatcacctgaggtcaggagtttgagaccagcctgaccaacatggagaaaccccatctctactaaaaatacaaaattagccgggcgtggtggtgcatgcctgtaatcccagctacttaggaggctgaggcaggaaaatctcttgaacccgggaggcagaggttgcagtgagctgagatcgcaccattgcactccagcctgggcaacaagagcaaaactccgtctcaaaaatataattataataaataaataaaagtaaagtattgatgtttgtgaatgatttattcttctaatgaactagaggagatttttccaggaatttcagagccagtgaggttatgttgcttgtatgtgtcatgtgtatccaggtgaaaaaacttaattaaacgctattatataataccatacataaaaactgaattttaggaatactgaagaatgacatatagaagtcaaatcattaaatagctagtagtaaacagaatagagtgtcagctgttacccaatgatgataatattttcacgattaaaattaaaccttttctgattttaaaggaaaagttcagatctgtatcatataaagaatgtaaattttcagggtaataaaattaaaatgcagagagaaaaatgcaaaaatagttcttactagatgtgtgtatgtaaggaacttagactaattttaagaacactgtcaagaccctggtagttaggtaggaaaaaagacatgaatgattcattcaacaaaaactttgagtatttctgtgctagatggtagtgttacagtggtaaacaaaataaatgtgtttctgctatcctggagcttagtctacaaaaaaggtacatattggccgggcacggtggctcacgcctgtaatcctagcactttggaagatcgaggcgggtggatcacctgaggtcaggagttcaagaccagcttggccaacatggcgaaaccccgtctctactaaaaatacaaaaattaactgggtgtggtggcggacacctgtaatcccagctactcgggaggctgaggcaggagaatcacttgaacctgggagacagaggttccagtgagtcgagatcatgccactgcattccagcccgggggacaaaagcgaaaatacgtctcaaaaaaacaaaaacaaacaacaaaggcacgtattaaatacgaacataaatatttacaaattatactgaataagttctcatgtttattatttgcttgtccagttacaaacttttccttcgtagaattagaaatataaataataaacatgagaactcattcagtataattaataattattaaatgtaaataaaaacatctatgtacaattaggcatttatttaagaattatttgaaaaaaaaacaatgtggaaacagatattttgatatattgctagtgattgaaattgataatgttcttttgaagagtaaagtgaccatatatattaaagttaaaatttaactcagcaatcacacgcctggtgagttatcttaaggaaatcagtttgaaagtaaaatcaatatatgcacaaagactttaacatttatcataaaccagaaaaatcgagtttcaaattatatcctatggactattttctgctaaaaagtattaatatcaactttatgtaatactttcgtgacaaatattttgggggagaaaacccaacaaaattacatgcattgtaattttttttttttttttttttttagacagtcttgctccagcgtccaggctggagtgcagtggtgcaatctcggctcactgcaacctccatctcccaggttcaagcaattctcctgcctcaggcctcccgagtagctgggattacaggcgctcaccaccatgcctagctaatttttatagtttttagtagagatggggtttcatcatgttggccaggctggtcttgaactcctggtctcaagtgatccgtctgcctcggcctcctagagtgctgagattacaggtgtaagccactgcacccagccttatgcattataattttaatttgtaaactgtacaaagggataatacttgtagtacaacaagaagtaaaaacatttgttataggtagttaacatttgtaaccagtagaattataggtaaaatttatttatttaaaacagttttagttggatttgatttcaactttaaaataatgcttttcatctctatcaggtctttttgcctggctttttgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcaggtattgactgattgcgtctgccattagggagaaaagcatacacatcctttccttcacatcccagtaacagatcctattatttgtaaattttaagttgtggaaaaaaaagataaaagccaggcacagtggcctgtgcctgtaatcccagcactttgggaggctgcggtgggcggatcacacgaggtcaggaattcgagaccagcctggccgacatggtgaaaccccatctctactaaaaatacaaaaattagccgggcatggtggcaggcacctgtaatcctagctacttgggaggctgaggcaggagaatcgcttgaacccaggaggcagaggttgcaatgaaccaaaatcacgccactgcactccagcctgggtgacaaagtgagactgtgtctcaaaaaaaaaaaaaaaagagagaaataaaattagcctacttactatcttctaatcaaagcatttgtggtaacttaaaatatactgtattgtaaagtatcatgctgtttcatttaggccattattctatttgaatctgtggctgtttctcttaataaatcaagtaatatggaatatattcatagcctctgaagagctctttatgtaagtatttatttaggatactttttgtaaaataagtgaatgaattcttaggtctcctttttttttcttttcttgagacagggtctcctcgctgcaacctggaaattctgggctcaaataatccacccaccacagcctcctgaatagctgggactagaggcatgcaccaccacgcctggctaatttgaaatttttttttggccaggcatgatggttcacgcctgtaatcccagcactttgggagaccgaggcaggcagatcacgaggtcgggagatggagaccagcctggccaacgtggtgaaaccccgtctctactaaaaatacaaaaattagctggttatggtggctcatgcctgtaatcccagctacttgggaggctgaggcaggagaatggcttcaaccagggagtcggaggttgcagtgagccgagatcacgccactgcactcctgcatggtgacagagtgagactccatctcaaaaaaaattttttttttaaatgatggagtcttgctgtgttgctcaggctggtcttgaacccctgacctcaaatgccgcctgcttcagcctaagtttcttttttttttgtaaagagacagggtcttgctatgttggccagggtagtctcaaactcctggcttcaagcagtcctcccaccttggcctctcaaagtgctgggattacaggcgtgaaccactacctataatgttgtgtttcactcaaggccttttgatttcgttttgcattaccgtgccacattgtgcatttccttgaccttttttgggttttttggagtgctttcatatgttaaaccatacctgattctcctcaaaatcacacaaagtagaatatcctaagacaagaaatctaaggaggcataaagaagttaactggttttattaaactcacacagtaaatgatagagccagaaatattccccttctagtgttcttcaccatcagcttaatgtagcataataattttctaattactgttgacaaataaataaccctttgaattttcaatactgggccttggataaattttcctaatttgtaagagagtattatcgtattgccatttacaaagctctcctgagtatctttttcttctgttaagtttacctaggagataaactgctgagtatggttgccattttggttttttgatataggttagaatgtcttggttttttttttttttttttttggtttttgttgttgtcattgtttgagacagcatcttgctctgtcgcccaggctggagtgcaatggcacgatcgtggctcactgcaacctccacctcccgggttcaagcaattctcctgcctcagcttcctgagtagctgggattacaggcatgtgcaaccacacctggctaatttttgtgtttttagtagagaaggggtttcaccatgttggtcaggctggtattgaactgctgacctcatgatccacctgcctcggcctcccaaagtgctgggattgcaggcatgagccactgcacctggctgaatgtcttgtttttgattaggcacttaagaaaggcctaggtactaaccataaaatatatttttataccttttgttgatactatatatatagaaaactgcacttatcataaccttagacaccttgaagaatgttcacaagcagaactaacccatgtgacccagcatccagatcaaaaacagcattatcagcccctctagaagccctcttgggccccttccattcactgtccttcttgtcaccagggtagctactatcctgacttttgatggcatagattagcattacctgttcttgtcattttataaataaaaccatactgtgtattcttttcttgtacagctttattgtgctaattcacatttacatcatacaattcagtggtttttatatggtcacagagttaggtaaccattaccacatcgattttagaacatttttttcactccagatagaaaccccctttacttaaactccaaatcccccactccaccagccctaggcagccactagtctactttttatctctatagagacaatagatttgcttattctggacatttcataaacatggaaccgtatattatgtggtcttttgttgccaactgtctttcacttagcatcatgtgttcaaaagagcatcatgttatccatgtttggcatgtatcagaattttattcctcattatggccaaatatcccattgcaaggatttatgacattttatttgaattgtaccctcctttctgccatttatcaataatgctactgtgaccatttgtgtacaagtttttgtgtggatacaggttttctttttgtttttaaatttgaggtggagtcttgctctgtcgcccaggctggagtgcagtggcacaatctcggctcactgcaacctctgtctcctgggttcaagcagttctcctgcctcagcctcccgagtatctgggactataggcacgcaccaccacgcccagctaattttttagtagagatggggtttcaccatgttggccagtctggtctcgaactcttgacctcaagtgatccacccatctcggcctcccaaagtgctgggattacaggggtgagccactatgcccggctgtggttttcatttcttttgttgtatatacataggagtagaattgctgagtcaagaggtaactcttaaacttattgaaaaactgccagattgttttccgaaaaggctgcaccattttgcaatcccaccagcagtgtatgagttttacagcttctccacatttcattggaacttattatctgtttggctgtttttaaaaatgatagtcattccaataagttctacttcagtgtggtttttgcacttctctgatgagtaatgatgttgagcatcttttcatttgcttattggcctttgttctagctttggaaaaatgtttattcaaatcctttggccatttttatttttatttttatttatttatttttttttgagaccaagtctcactctgtcagccaggctggagtacaatggtgtggtctcagctcactgcaacctccgcctcctgtgttcaagtgattctcctgcctcagcctcccgagtagctgggattacatttcaggcacctgccagcatgccgggctgatttttgtatttttactagtgacagggtttcaccatgttagccaggctggtcacaaactcctgacctcaggtgatctgcctgcctaggcttcccaaagtgctgggattacaggcgtgagccattgggcccagcctagattttcttttttctttttttttttgagaaggagtcttgctcttgttgcccaggctggagtgcaatggcacaatcttggctcactgcaacctctgcctcctgggttcaagcgattttcctgcctcagcctccccagtagctgggattacaggtgcctaccaccacacccagctaacttttgtattttttttagagacagggtttcaccatgttggccaggctggtctcaactcctgacctcaggtgatccacctgccttggcctcccgaagtgctgggattaccggcatgagctaccaggcccagccaattttctcattatattgcccaggctggtctcaaactcctgggttcaagtgatcctcctgccttggcctcccaaagtgtggggagtacaggcgtgagccaccttgctcagcccctttgcccatttttaaattagattgcctttttatattgagtttcaggagtcctttatatattctagataaatgtcccttatcaaattatattatttccaggtattttcttcattctgtgagttgtctttcctctaccttttaaaaaaggtgggtttttgtttgtttgtttgtttgtttttttaagataaggtctcattctgctgcccaggctggagtgcagtggcacaatcacagctcactgccacctcaacttcctgggccgaagtgatcctcttacttcagcctcctgaatagctagggccatagatacacactatcacacccagctttttttttctgtttgtagagacagatcttactgtgttgcccaagttggtctcaaactctaggctcaaagtgattctcccacctctgcctcccagagtgctgggattacaggtgtgagccacacgcaacctgtcttttcactattaatagtgtcttcctgcttcagcctcccgagtagctgggattacaggcacccaccaccatgcctggctaatttttttgcatttttagtagagacagtgtttcaccatgttcacccggctggtcttgaactcctgacctcaggtgattcacctgccatggcctcccaaagtgctgggattacaggcgtgagccactgcacccggccaaaatattgccttcttaacagtattgtcttctaatttgtgaacatggatgtatcttcatgtatttatgtgttctttcatttcagcagaattttgtagttttcagagtagaagcctttcacctccttgggtcatttattcctatgttttaagttcttttcgattccattataaatagaattgttttcttaatttcattttcagattgtttgatgagagagcatagaaatacaagtgatttttacatgttgatcttgcaacttcaactttgataaatctgattgttagctctaatagttttcttgtggattctttaggattttcaatatataagatcatgtcatttatggatagagatagttttttttctggctagaacttacagagcaatgatgagtagaagtggcagaagcaaaaatctttgtcttgtttcctatctgacagggaaagctttcagtttcatcatttaatatgatgttaggtgtgggttttcaataaatgccttttttcagattcaggaatttccctatcattcctgattttttaaggcttttttttttttttaaatcatgaaagggtgttgaatattgtcatgttctttctgtatcagtataaatgatcctatggattttgggttttattctgttgatgtgaaatattaattgattttcagatgttaaaccaaccttgcatacctgagatgaatctcacttggtcatggtgtataatcttttcaatatgctgctggattccatttactggtattttgttgaagattttgtatctgaacgcttaagataacatttacactctatcagaaatgaattgaccataaatgtgagagtgtatttgtgggttcttgattctcttccattccaaagatagacatacatccgtctgtatgtctgtctttatgccagtaccatactctcttgattactattgctttgtaataagttttgaaatcagaaagtataaatgagattttggtatctgagtaacagtcctcatagaattagttgggaaatattccctctttattctggtccctctttcttttttgtttaactgtgtatcttggagattgttccttctcaacacatgagagccgctttccctaccctcccacccctgctatagagaggtctataagtgtctgttcaattattttatttacttaacctattacttagtcggggacattaagcttgtttatgtcttttattttaaacaatgctgcagtgaataatcttgtatataagtcattttccatcaatataagtctctctgtaactgaatttttagaagtggaatttctaggtcaacctatggctctgtatttcacaaaaataccaattctggtttttcttgtggaggtggggagtaggaggtagaatgctggaggagaacttgctgtactcagctggctagtcattttagaaaggtttccttagcttctttttgtcatatggcctcaccaagaatcaaaaacattcctatttaccctgtaaacatggggctttactacccaagatacatatttctggatgtatgacagcttttcatattgaagaaataatgctgtgagtacagcacatttgttggaacttaggtcgttaagaatgtcttataaattcatacattatacattttattttattttattttttagtttttgatacagagtcttcctctgtcgcccaggccagcgtgcagtggtacaatcttggctcactgcgacctccatctcctgggctcaagtgattctcatgtctcagcctccagagtagctatggttacaggcatgcaccaccatgcccggctaatttttttatttttagtagaaactgggtttcaccatattgaccatgctggcctcgaactcttggcctcaagtgatcggcctgcctcagcctcccaaagtgctgggatccttgtattgggtaaaagatgaatattgagggctgcatggtggctcatacctgtaatcccagcactttctgagactgaggtgggaggagtcctggagcccaggagggtgaggctgcagtgagttgtgatcgcgccattgcacttcaacctaggaattataggcttcagtcactgtgcccggcatgtacattttaatattgtgctttcctcttttagctatagtatgaggttacatttcagagtcattgttgttaagcatcttaatagtgatgaggttgagtgaaagttacttctatttcaaacactgaagaaaattttgtacaaatctgtcacattccaagcccaggactgattgtttcatatacttctaattttacaatttctattgtagtccagtgtgaaaaaagccagtattaaaatactgaaaaattttgatgaagcgataattgtggatgcggcaagtctggatccagaatctttatatcaacggacatatgccgggtaagcttagctcatgcctagaatttttacaagtgtaaataactttgcatcttttaaattttttaattaaattttacatttttttctaatctattattatatgcccagaactttcacttagagtgtgcagtataatgtggtggttaagtataaaggctctggagtgacttcctgggttttaatcttggctctgccatttattggcagccgctaacctcttggtatctcagtttcttcatctgtaaaatgagaataataaagtgaaaagatgccaacatcatttactctgggctgcataactgatacttggaaaaagtattcctttgagtttaagaattaagttggttattcattttagcttgtaataaaaagatagtgattcataggatatgccacttactgaaatttaccacagatccaatcataaaatcactttctcttccctaaagatagcttgattaacatgtaaaggtgtgtaaaggcttgattacactaccctgatccgtaccccagttcccagcagcaccatgaaaaagggatttcaacatatttaattactttcagtagaaagtaacagtggtaggccaggcgcagtggctcacacctgtaatcccagcactttgggaggccgaggtgggcggatcacgaggtcaggagattgagaccatcctggctaacacgatgaaaccccgtctctactaaaaatacaaaaaattagccgggcatggtggcaggcacctgtagtcccagctacttgggaggctgagacaggagaatggcgtgagcccgggaggcggagcttgcagtgagcttagattgtgccactgcactccagcctgcgcagtggagcgagactcttgtctcaaaaaaaaagaaagtaacagtggtattgggagactgaggagcctagaaagtacttgaaggaagtaaaaggtttgtttgaccacattgtatttggaaagccagctttttcagctgtgtcagctttgtgtagtgatttttagttcttcttttagaaaataacggacaaggccgggcacggtggctcacgcctgtaatcccaccactttgggaggccgagacgggcggattacctgatctcaggagttcgagaccagcctgggcaacatggtgaaaccccgtctctactaaaatacaaaaagttagccgggcgtggtggcgtgtgcctgtagtcccagctactccggaggctgaggcaggagaattgcttgaacccgggaggcggaggttgcagtgagccaagatcacaccattgcactgcagcctgcgcgacagagtaagactctgtctcaaaaaataataataaaataaaaaagaatggacagtaaacctaaatgagttcattcccaaagatgatgttattcttaagggatggttcatttatttaagaccttacataaagtctatcaattgcgtgatttttcacttctgtaattgtgtgtatgtataatgtaaatatatatgtttttgttttgttttggttttttgagacggagtctcgctctgttgctcaggctggaatgcagtggtgcaatctcagctctctgcaacctctgtctcccaggttcaagcgtttcttctgcctcatcctcccaagtagctgggactacaggcacgtgccaccacgcccggctaattttttgtatttttagtagagatggggtttcaccgtgttagccaggatggtctcaatctcctgacctcgtgatccacccgccttggcttcccaaagtgttgctattacaggcatgagccaccacacccagcatgtattttttaaatgtataaaatgaagcagaaaagagaaatgataatttttcttcatcttgaaagattatcttcaccaggcgcagtggctcacacttgtaatcccagcactttgggaggcctcggcaggcggctcacttgagttcgaaaccagcctggccgacatggtgaaactccgtctctactaaaaataaataaataaagatggttttaatatatgttttagttttatgattttagcatctttctgaaatttttctcaaggcaagtaaatttgtatcagttggtatattggtacccatctatgaaataacttattaggaagatatctctaaaataagatcactttgcctaaaataaactgatatattgatgttcacagaatttttcttttaaccgacttgataaatgcattattcttgacgtcaagtgatccaccttcctcagcctcccaaagtgctgggattacacacatgagccaccgcacctggcattattcttataaaaggttaaatttctagttaagtttaatgtcctctttgttcatgtaccattgcttattttcttcccttcctactcacagtaatcattcttatggtatgcacttttgtttgcttatttttatgtaattgatattacgctccattctgtacgttgtactttcattcacagtgagttttggacattcctatgttcatctatacagacttacttcattttaactacactgtagtattccgtatgtaatatttactataactcatcactgtagcagagcatctcatagtgtatgtattactgttttgccattttggtatcaatgagtatttaagtcatttgcagtttttccctcttatacccagtattacagaggatctctttttatatgcttctttgtaccaagaggcagattaaaaaatttttttttgaaaaaatttttgaaaaaaaatgaaatgaagtctcactatgttgcccaggctggtctcaaactcctaggctcaagcaatccttccatcttggcctcccaaagtgctggggttacaggcatgagccaccatgcctggcctacattttaaattttgatagctcttacaatttactttgtaaagtatctgcatcattttatgttctcaccagtctttaataagaatacttcatacttttggctggacacagtggctcacgcctgtaatcccagcactttgggaggccgaggcgggcagatcaagagatcgagaccaccctggccaatatggtgaaaccctgtctctactaaaaatacaaaaattagctgggcgtggtggcgcacccgtagtcccagctactcgagaggctgagacaggagaatcacttgaacccgggaggtggaggttgcagtgaacttagatcacaccactgcactccagcctagcaacagagtgagactctgtctcaaaaaaaaaaaagaatacttcagacttaattttttttccagtcttaagtgtttgctaatgagattgagtttcttttggtatgtctcttgattgttcaggttttttcttttatgaattgactgttcatctctttttcacattatttctgttgggtgattttattagtgacttgttaaaattctgtatattttttcagcatgacacttcattattcaaaaaaaaaaaaagattctctatgtttctcgatactaatcattggttggtaataccttaaaaataagacccttactgtattttttgcttttttttttttttttttttttttttttttgagatagagtcttgctctgttgcccaggctggagtgcaatggtatgatctcggctctcagctcactgcaactgcaacctctacctccctgtttcaagcaattctcctgccttagcctcccaagtagctgggattacaggcatccaccaccacacccagctaatttttgtatttttagtagagacagggtttcaccatgttggccaggctggtctcaaactactggcctcaagtgatccgcctgcctcggcatcccaaagtactgggattacaggcatgagccacagtgcctagccactttttgctttttaactttgttttatagtactatagttttagtataaacagatgtatgtatacacacaactatggctttataatatgtttcagtcattgttagagcaaggcctaccttttgggtgcttcttttacaaaattgtcttggctattcttgtgccttttttcttatttgtgaattttagaattgtgaattacctgttgactcaccatgttttgtaaactgaggattttgaatggaattgcactcaattaaagattatcttgctttctgtgcagcaatgttttatttcaaataatccctactttaaattacttaggatagctataaattgtgtttctggctttctagatttagatgaaacgctttaaattgattgttttctcctaaatttaaaactgattgttagaagttaaagtcttctgttcattcttatttaggaagatgacatttggaagagtcagtgacttggggcaattcatccgagaatctgagcctgaacctgatgtaaggaaatcaaaaggtttgtggtgtttttatacttcatattaagcctttactcacattagtgattgactgtaagtcaaagaccacttaaggtttaaactgtttattttgtaaagtaaccactgtatctttcaccttgtgtttatagtcagaagtaagtacaagggcttcctgtagtcacatctttatgcaatctcctctgaatcaaaagttagtgaacttgctttgccactccagaaggcacatgaatatgaaaaagcattgtctattttcttatttaatggcaaaatacccgacctaagttggacttaatgtttgagaccgtttattttattaaattatattttttctcttttcttttttttttttgagacagttcttgctctgtcacccagaccggagtgcagtggtctgaccgcacctcactgcaacctctgcttcctaggttcaagcgattttcctgcctcatcctcctgagtagctgggactacaagtgcgcaccaccacacctggctaatttttgtatttttagcagagatgaggtttcaccacgttggctaggctggtctcatactcctgacctcaagcaatccatccgccttggcttcccaaagtgctgggattacaagtgtgagccaccatgcctggccttattaaattatttttattaaatttcctcaagattgatgaaagtaatgaaatataaaagtaatgaaatatatgtggaaaatagactggattaagaaaatgtggcacatatacaccatggatactatgcagccataaaaaaggatgagttcatgtcctttgtagggacatggatgaagctggaaaccatcattctgagcaaactgtctcaaggatagaaaaccaaacaccgcatgctctcactcataggtgggaattgaacaatgagaacacttggacacagggtggggaacatcacacgctggggcctgtcgtggggtggggggctgggggaggaatagcattaggagatatacctaatataaatgacgagttaatgggtgcagcacaccaacatggtacatgtatacatatgtaacaaagctgcacgttgtgcacatgtaccctagaacttaaagtataataaatttaaaaaaaataaatatatgtggaaaatattaataggtcaaaattcaaattgttcatttaatcagaagagtagtttagtcaaatccaagggttagacaacagaaatcttttttgtcaagtgcattctttgtgactgatttcattttcttcctggtttacacaggaagatttcagaaacaaatgtggatccgtgacagatggtatctagaagtttttagtttggttgaattgacagtattttattgagtaaaagatactaatttttgtaagaagaaaaattcaattttgataagtatgtttaagattaagagctattggccaggcgctgtggctcatgcctgtaatcctagcactttgggaagctggagcaggtgggtcacgaggtcaagagattgagaccatcctggccaacatggtgaaaccctgtctctactaaattagccaggcgtggtggcacatgcctgtgcacccgcctccgggtttaagcgatcctactgcctcaggctcctgagtagctgggattacaggcgccatggctaatttttgcatttttagtagagacagggtttcactacattggccaggctggtctggtctcaaactcctgacctcaggtgatctgcccgccttagcctcccaaagtgctgggattacaggcatgattcaccatgtctggccatttatcttattttcttttttttttttttttttgtttgagacggagtcttgctgtgtcgcccagagctggagtgcaatggtgcgatctcagctcactgcaacctctgcctcctgggttcaagcaattctcctgcctcagtcttccaagtagctgggattacaggcgcgtgccaccacatctagctaatttttgtatttttagtagagacagggtttcaccatgttggccaggctggtctcggaactcctgacctcgtaatctgcccacctcggcctcccaaagtgctgagattacaagtgtgagccactgtgcccagccatcttattttctttctttttttttgtcgggtgggagggggacagagtctagctctgtcgccaggcttggctcactgcaacctctgccccccaggttctagcaattattctgcctcagcctcccaagtagctgggattataggcacctgccaccacgcctggctaattttttgttatttttagtagagatggggttttgctatgttgaccatgctggcctcaagtgatccgcccaccttggcctcccaaagtactgggcttacaggcgtgagcttgtattgggtaaaagaacaatattgggggctgcatggtggttcatacctgtaatctgagcactttgtgagactgagatggaaggagtgttggagcccaggagggtgaggctgcggctgcagtgaattgtgatcacgccattgcacttccacctaggtaatggagcaagaccatgtctctaaaaaacaaaacacaatttttttaaggaatactgggaagaggtcagtggtggttttagaacagaggaagtgccagatgacctttgtgaggcattggccaggaagaactctacagtgtctttaggtagcttctgtccataaggataatggggtctcctccccagtattaatagaaaatctctgagctgtttttttttgtttgtttgttttgtttttttttcctgagatggagtctctctctgtcggccaggctggagtgctgtggcgcgatcttggctcactgcaagctctgcctcccaggttcacaccattctcctgcctcagcctcccaagtagctgggactacaggtgtccaccaccacgcccagctaattttttgttatttttagtagagatggggtttcaccatgtcagccaggatggtctcgatctcctgacctcgtgatccgctcgcctctgccttgcaaagtgctggagttacaggcgtgagccaccgtgcctggcctggtttttttgttgttgttatttatttatttatttatttattttttgagacagactctcgctctgtcgcccgggctggagtgtagtggcacgatgtcggctcactgcaagctctgcctgccaggttcaagccattctcctgcctcagcctcctgagtagcagggaccacaggcgctcgccaccacgcccggctaattttttgtatttttagaagagacggggtttcaccgcattagccaggatggtctcgatctcctgatgtcgtgatccgcccacctcggcctcccaaagtgctgggattacaggtgtgagccaccgtgcctggcctgatttttttttttttttaatctggtctcatacctctgacagctcatgaagaagtgctcctgcttcatatgtatatgtgttagcatagtgttaacatagcataggtgttcggtgtttgcagtttctgtttgttttatatgaattaaggtgtattatgagcagttgaagatatataggaaattttttcccaaaccactatctctgctcgttctattcattcagtctgtttatgttattccttcattcattcattttatagaacagtggagtgcctactgtatgcatctattgttctgggtcctggggaagaaaacaaagttcctgctttcatggaacttacattatattggcggagacagtaacagacaaacaaatgtagcctgtgtacatgtgttacatgaaaagcagggtagggggctgggagagagtagtagggagtgctattttcgaggtggttgtcaggaaaggcctcactgaggaggtggcattttgagtagacctgagcgcagcgggggcgtaagcccaggcagcatgtggaggaagagtgttcttggtgaaaggaacaaggatagaggcccgaagctagagagctcagcatgatcaaggaacagcaagccccgtgtggctggaatggagtgagcaaaggaatgagcagtagaaggtgagtgagttgggaggtcaccagagaccatggcaaggacttgaaagtgtcagggacacattggaagttggagcagggaaatgatgggatttatgttttgtttttgttttatgtttagtgtttttaagggattgctctatcagctatttggaaaatttagtgtagggcttcaagaagagaagcagagaaacaacattcttgccatagtcatagtctaagtaagggatgatggtggtgtggattaggctggtagtggaagaccagtccagttcgggttgtatttgaaggtagaggcaaaaagattatatttctaccagcaagcccatctatgaagttacttgtattattaatttaattgagacatgcccacataaactaataaataggaatttctgcagtttggttaaacacccctgtatatcctggttcttcttttagttgtccagatgtctctttaagtcaagtattttttggtggtgtaggagcctagagattgaatttattcacccaaaaggcatttgagtgattactatgtgccaggcactatgctgaatgccaaggatgtaaataagagggcgtagtctcagtctgttttactccagcttggttcctttttaatgaccctgacttgttaagcatatcagttatcctacagaatgtttaatcttctgtactttcctggttgtgttatttagcttatttctctttccttgacatttcttgtaaactggaagttacacctatagtcttgatgattcgtgttacacattttagattagaacacatcatgtgttgtatatggtgtttttgaaagcctctctgtatattggtctgtacattaaaatgttgcctgaatggatacacataaaatttaacagtgattacattagagatgagaagaaagaggtgccttttacttttcaatataccttttcctctgctttttgaactttcttgccctatgcatacgttattgcttaatcatccacctcatctcttcccctgtggctttctgttgcatttggaatgaaatctagcctctttgctgttacctgtggatgtcccttgctggcctctatcaccttactttgaaccactcctttcatggactgagctctcattggactatcttttattcttttgctgaagtttcttcactttgagtgcctctgcagttgctatttcatggctgtggcaagccctgccatggctttcatgcaaggatggttcctccttctcatctcaatattatctcttcagagagggaccttcccaactccgatgatctaaaatcctttgtatataccactcactaccacttctttcttttcttttccttttatcttttttttttttttttttttttgagatagggtcttgctctgttgcccaggctggaatcacgactcactgcagcctcatcttcttgggctcaaatgatcctctcacctcagcctctcgagtagctggaactgcaggcacacaccaccatacttggcttattattttactttttgtagagacagggtttcaccaaggctggtctcaagctcctgccgcaagcaatccacatctctcagcctcccaaagtattgggattataggagtgagccactactcctggcctattttcttattcactgtctaaaattatcttgttcatttatttacatacttgtttatagcttatttctcagctggacatggtgcctcacacctgtaatctcaatactttgggaggctgggttggagaattggttgagcccaggacttcaagaccagcctgggcaacaaagtgagaccctgtctataaaaaattgtttaaaaattagctgggcatggtggcacatgcctgtggtcccagctacttgggaggcagaggtgggagaatcgcttgggcccaggaggttgaggcgacggtgagccatgattgtgccactgcactctagcctagtgacagagtgagaccatgtgtctaaaaagtaaataaaaatagtttctctttcatgactagaatattacctctatgtgggcagggagtttgtctatactatttggcactatatttcctgattctgaaattatgcctagcacatggtaagtactccttaaatatttattgactgaattatttaatacttaagaatttcatttgggattatctgagtggtaagattacggattatatttatgtaagaaaaaatcattttttaaacttggttgccctttgccacactgacatagacactaagttttcttagccagattacttccgaggatactcacagaggccattctcttctcaatccccaaataattgatatttcttagcactttcaagctaatgcaattcttagatgatgtatctgtgtatatcatatcctcattctacaaatgtagaaattgaagtctgggcacagtggctctcacctgtaatctcagcagtttgggaggccaaggcgagcggatcactgaggacaagagttaagaccagcctggccaacatggtaaagccttgcctctattaaaaatacaacaattagggccgggcgtggtggctcacgcctataatcccagcacgttgggaggccaaggcaggcagatcacgaggtcaggagttcgagaccatcctggctaacacagtgaaaccccatctctactaaaaatacaaaaaattagccaggcatggtggcacgcgcttgtagtcccagctatcgggaggctgaggcaggtgaatcccttgaacccgggaggcggaggttgcaatgagctgagattgcaccgctgaactccagcctggtcaacagagggagactctgtctcaaaaaaaaaaaaaaaaaacaattagccaggcgtggtggcgggtacgagtacctgtaatcccagctactagggaggctgagggaggagaatcacttaaacccaggaggtggagtttgcagcgggctgataatgcaccactacattccagcctgggcaacagagtgagactctgtcttaaaaaaaaaaaaaagaaagaaagaaattgaggaatgtggagattgtggtctgtgatttgttaggaatcacacagcaggttagtagcaactacagggctttggttcagaataccaccttgacaatggtttgtttacagttcggctccccttcctctgcctttctctccttccttattgagggcagctggaaagaattttcatcatttactagcctatagctttaatttgagttttgaaaccttgataatagagcacagaggaaaagactgagttttctttttttgagacagtcttgctctatggcccaggctggagtgcagtgacaccatctcagctggttgcaacctctgcctcccaggttcaagcaattctgcctcagcctctcgagtagctgagattacaggcacgtgtcaccacgcccagctaattttctgtttttgtttcgttttgtttttttctgagatggagtcttgctctgtcacccaggctggagtgcagtggtgcgatgttggctcactcaaacctctgtctcctgggttcaagcaattcttctgcctcagcctccccagtagctgggactacaggtacgtgccaccatccctagttcatttttgtatgtttagtagagatggggtttcactatgttgaccaggctggtctcgaactcctgatctcaggtgatctactcgtctcagtttcccaaagtgctgggattattggcacacgcctatttttgtatttttagtagagacggggtttcaccatgttggttagactggtctcaaacttctgacctcaagtgatttgcccgccccagcctcccaaagtgctgggattacaggcgtgagccaccgtgcccagccaagattgagttttgaaaagagccttctgagattatgagaagggcaagcaagataacttaagaagttacattaaaatcatctaagagacagtgtaacaagaaggaattgtaaaatgatgttatgagcacgtgcccaatgtagtggcaatcccttgtgcttcgatacattggtgggagacaaaactgtacttaaattgataaatcccttacatgtcattttaaggagcttagactgactcccatcatgtagacatcagagatttcttttttttttttttttttttttttttttttttttgtgacagagttttgctcttgttgccgaggctggagtgcaatggcgtgatctcggctcaccacaacctccacctcccaggttcaagcaattctcctgcctcagcctcccgagtagctgggattacagccatgcaccaccacgcctggctaattttgtatttttagtagagacggggtttctccatgttgtggctggtctcgaactcctgacctcaggtgatcctcccgcctcagccacccaaagttctgaaattacaggcgtgagccaccgcgcccagcccagagatttctaaacagagttctaaccagatgcttttccctgtcagtagaatgagaatgaattggaggtgggagagactggcatgagggacaccagtcagccagtggaattagctggtaatgttgataggagaagaaaaagattcaaagttaggtagtggtagcaagaattagagggaaggtcggatttatgatatgtccaaggttgaattctaaggtgaaatttggtggcagatttcatgtgtaaattgggaaggtagattgagtttttttaacatgggttttctaacatgtcaatagagtgactctgcaggggggcctgacgagagaacagtgcatggggtgattcaacagccagttgagccttcatgcagagcatttaacactgtgactctgtagactctggttggcagtaaaatttcattaaaccaatatttaaacccttaggtaataataaaaattgagggaaaaggatccaggttttgtattttttatgaattcagttattgaattaaacaggaccttgcctcaagaaataatctaccaacaattaacttgttttaaagcaaagttaggaagtgagcatgttcaaattattaaataaaaaagtaagctgtgtatttcattcatagaaatagaggctggcctacttcggatgattctcagcatgtgattacagatgtgggcttatacatcctagggagttaaggcgtactctggcttggatagagtagagctctttgaaactcttctctcacccagctagtttatatagactagagaactagaatgtagcagcatactctgtcttagaagcccttttatataggagctggtctggaaggtttgaaaacataacaaatgtgttggtgtctcccaatgtattgctagattcttacccaagagcattatcctggttagggtttggtttggttttgttttgttttttaatgtttgccacaaactaacactagatgttagttctttcatcaagtgaggagagtagaagaaaagtccagaactctgaaacaccttttcaaaagtttttcaagccatgatgtttgcaagttaaatgctctgttatgtaagcaatataatcagtttttattaatgtaacattccttagtgttttggggtatcacacaaaaaagaatatccatatctggaagcaacagcttttaaataagagcattgtggtggtggtggtgatagtggtttttttttttttttttgagttggagtctcgctctgttgcccaggttggagtgcagtggcacgatctcagctcgcttcaacctctgctcccaggttcaagcaattcttctgcctcagcctcctgagtagctgggattataggcacctgctaccatgcctggctgatttttattattttagtagagacaggtttcaccatgttggccaggctggtcttgaactcttaacctcaggtgaatcacccacctcggcctcccaaagtgctggaattacaggcatgaaccaccatggccagccaaataagagcatttttaatgtaaaattatgcatgaaatgtacattcaattttgtctttgtttactaggatccatgttctcacaagctatgaagaaatgggtgcaaggaaatactgatgaggtaaatcctacctttaggataaaaagatttctgtttataagtgccaccctcatgtaagtgaggtttaaaattttccttttctttaggtcccatgtttaagcagcatggcacatttatgttctcttacccagaatgtaccaagaaagggtggtcccttcttaacatctaacaattgcctggtagtagcagtgaaggtatcttcagtcagaggctaggaccactgaaggatatacatgcattcaagtttccatcagccagcaggcatcagtaatcagtgtgtagatcaaaagctcaaatgtttccttccccactggcagttttacttcaagtagtggaggcttgcttttttaatagttaattaagtacattgagagatgggaggtgaaaaaaggaaaatgttttattttgaccatctaatatgaaagtagttcggtgttaggtatccagtagttgacactggaagacagggaatgacatgttaatattcatagccagagggtggcccaggttttttcgtacatgggaatgaaattcttatccaaataagtagaaattatgtgcgtaagccatttgttaagagcactgagtatgtgcatctcgatccatctaatgaataaccattatcaccagtttaaattattttctttaggcccaggaagagctagcttggaagattgctaaaatgatagtcagtgacattatgcagcaggctcagtatgatcaaccgttagagaaatctacaaaggtaaggatgacttcgttttgtgtaaactaaaaagtattattttccaggtgtaaaaataaaaaagaacataaggggtttctttgcctttgaaggattaactgctgtggggattaccttcttatcataagcaactagaaaattgacaaactaaatgaaacaactgtttgcatatattggacaatgggcaatacagggaaaccatggaaaccaaacagagcccagtagtcttgctgaacgaaagagttaaatatcaaagttcaggccaggtgcagtggctcacgcctgtaatcccagcactttgggaggccaaggcgggtgaatcacttgaggtcaggagttcaagaccagcctggccaacatggtgaaaccctgtcttagccgggtgtggtggcaggcacctgtaatcccaactatttgggaggctgaggcaggagaatcgcttgaaccagggaggcggaggttgcagtgagccgagatcacaccactgcactccagcctgggcgacgagcgaaaccccatttcaaaaaaaaaatcaaagttcagagagctcaatttgagtagaagttgtaggataaggtagcagaaaagaggaagctgcccagaaagaaagccgtagagatatttagagagattcccatggatccttggcctaggagtgatctgtatatgtgtggggtgaaaacgcatgtgtccaggtagagaaccccccagaaattagtaggctgaatgattgctggaacatagggctaagaaaagttcatggccagaaggatctggccagagtagagagacttagtaatacacaaggcattgggtagtgtcttcacagaggttatgccttactactgaagataaattagtcctagagtacaagcacctgaaccaagtttcaaagcaaatttttaaagggtcaaattacctaacaactgcatgccaaaacaaaggcctaaccctctttacagtaacacaacaaaattcagcacttcacagtgtaaagttagaatgtctgacgtccaggctgggcgcagtggctcatgcctgtaatcccagcactttgggaggccgaggcaggtagatgacctgaggtcaggagttcaagaccagcctggctaacatggtgcaaccccgtctctattaaaaatacaaaaacttagccaggcatggtggccggcacctgtgatcccggctacttgggaggctgaggcaggagaattgcctgaacccaggaggtgaaggttgcagtgagccgagatcgcaccactgcactctggtctgggcaaaaagagcaaaactcaggctcaaaaaaaaaaaagaatgtctgacgtcaatcacaaattaccaagcatgacatgaagttgacctataaccaggagaaaactcaatctatagaaacagacccagatgtgagaaagatgatgaatttagcagacaaagaccatcaagtggctattttaaatattaaaaatatgttcaagtggccaggtgcagtggctcatgcctgtaatcccagcactttgggaggccaaggtgggtaggagttcaagaccagcttggccaatatggtgaaaccccttctctactaaaaatacaaaaaaattagctgggcatggtggcaggtgcctatagtcccagctatatgggaggctgaggcacaagaatcacttgaacccgggaggtggaggttgaggttgcagtaagccgagattgtgccacttgtactccagcctggacaacagagtgagactctgtctcaaaaaaaaaaaaaaaaaagttaaagaaaacaagagtataatgagaaaaatgcaaaatagttttaaaagaaccaaatggaatttcttaaaataaaaaataccagaaatgggggccgggcgtggtagctcacgtctataatcccagcactttgtgggggctgaggcaggcagatcacctgagatcggtagttcaaggccagcctgaccaacatggagaaacctcatctctactaaaaatacaaaattagctgggcgtggtggcgcattgcctgtaatcccagctacttgggaggctgaggcaggagaattgcttgaacccgggaggcagaggttgcggtgagctgagattgcaccagtgcactccagcttgggccacaagagtgaaactccgtctcaaaaaaaaaacaaaaaaaaacagtagactcgaagaactagctgagtttttctttactttaggcagtaagtgtgaccttttgcaggtgactactttagttcctcatgtcctcattagtagatcagagaaattcgacaccaaaaccccaaaagaaaaaccccttctaatcctcattccatgattttatgaatgcatgaagtcctaggcctgcgaaggaatactcattctctttatcctgtgttgatacctctctgcttcaacctccaactcgacatttgcctataggatgtacttggacattcagcataaactacctcacaccattactgaattgcttcatgtgcacatgtcccatgccacaataccggggaccttgtcttccgtgatatttgtccgcagtgctgtgactacaggagggagtcagtgaatgtctgcatgtgtgtctttaccatccctcttgaatatgctctagggttaattcctagaagtagaattactctattgaaaattggcaatatttttcattctaatatctattgccaacatgggaaagcaagtctggatgccagtccttgttatatgccccttgggtaagttacgtaacctctttaagcttctgttcactcatattttaacaaggaaaattacaatattttacctcacaaaattgtagtcagcttctggctgtcttaaactctggtatatagtaaacactaagtgttggtgtccatccttaatttgtaataataggtcacttgttagagaaatgcaccttaccattttcttttcttttcttttttcagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgcggcgccagcgcttcctcaatgcacatgattgagaggaaagaaagttctcttagatgttactgcttttgctcagactttgcaaaaaaaaaaatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggcaactcttgctgcctctgcatgttttggaataacaatttctacaagactctaggctgtttaaactagtgctttcagttaagataaattctaatcatttctttgtatatacattttgtgcttctgagctagagatgccaagtagttgtaaactgcttataaagagaatagcagcaaatttgagactcggctacttttttctgccccacctgctttgagacacagaagcggagtgtggcccgaaattattagccagatttaatatttgatctaaagtaggtccttgtactcattttaaagttggaatttgattcctccaacattgagcacccaccatgttccaggctctgtgcattgtgcccacaaaataagattccctggtggagtttttatgggttcaaataatcagttgaacacccttcatctttatcatgttgttgacattgacacaaattgtttaaaaagaaaagatattagagagaaagtggtacctttgtaacttgatgtgtcttcatcattcggtaagatttgatgaaagtaaaaagcaaatgtcagccaaatccagtgaacagcaataaaacagggagtaactttttataactttttctacttggatttcaacattcagtagagcttttcgaaatgtaagtagtttacagtactggaggtttgactagttcagtaggaatttggaggggaaggtcattctgaattgtaacaaagtacaaacttctttgctgttttatttaagtactgagagctaagcacctgatgaagtgactgacctctctccagtgacagtgtttgggtacctgcctgacttcaggagtggggtttatgtttctacacagtgaccttttctctcgccctctcctccctcttgcccacacaccagttgattggacctgggttgaactcctgatccagacaggcccaagacagttcttaatgttaagaattttggggccgggcacggtggctcatgcctgtaattgcaacactttgggaggccgagacaggcggatcacttgaggtcaggggttcgaggccagcctggccaacatggtgaaaccctgtctttactaaaaatacaaaaattagctgggcatggtggcgcacgcctgtaatcccagctacgtgggtggctgagacaggggaatcgcttgaacctggaggcggaggttgtgcaatgagccgagaccgtgtcactgcattccagcctgggtgacagagggagactctgtctccaaaaataaaaataagaaaaagaattttgggctaggtgcagtggctcacgcctgtaattacagcattttggaaggcccaagatgggcagatcacttgaggacaggagttcgagaccagcctggacaacatggtgaaactccatctctactaaaaagacaaaagttagccagatgtggtgatgggcacctataatcctagctcctcgggaggctggggcaggagaatcacttgaacccaggaagcagagattgcagtgagccaagatcacatctctgcactccagcctgggcaacagagcaagactctgtctcaaaaaaaaaagaatttggccaggcgcagtggttcacgcctgtaatcccagcactttgggaggccaaggcaggcagatcacgaggtcaggagatcgagattgtcctggctaacatggtgaaaccctgtctctactaaaaatacaaaacattagccgggtgtggtggtgggcacctgtagtcccagctactagggaggctgaggcagaggaaggatgtgaacccaggaggcggagcttgcagtaagccaagatcgtgccactgcactacagtctgggcgacagagtgagactccgtctcaaaaaaaaaaagaattttggccgggtgcggtggcacatgcctgtagtcccagcactttgggagaccaaagtgggcggattacctgaggtcaggagttcaagaccagtccggccaatatggcgaaaccctgtctcttactaaaaaaaatacaaaaattagccaggtgtggtggcgggcacctggggaggctgaggcagggagaaatgcttgaaccggggaggcagaggttgcagtaagccaagatcgtgccactgcactccagagcaagactctttctcaaaaaaaaaaaaaaaagaattttgcatggggaaggagagatactgttcaccatctggaatggtgcttggatgtggcacttacaaaatcaggagccagcactgcatggacaaacagaagcatgtgggcctgagatagcaggtaccttgataaccctgaagacatccttggtttctgcatctattcctgcatccttgcattggactacattaatctgtcagttatccttataatgatttttgattttttttttttgagatggagtttcgctcttgttgcccaggctggagtgcaatggcacgatctcggctcaccacaacctccacctcccaggttcaagtgattctgctgcctcagcctcctgagtaactgggattacaggcatgcgccaccacacctggctaattttgtatttttagtagagacggggtttctccatgttggtcaggctggtctcgaactcccaacctcaggtgatcaccctgtctcggcctcccaaagtgctgggattacaggcgtaagccatggtacccggtctgttttttgattttttgaaaccagtctgaagtgagtttttttaattacgtgaaaggagtttggctaaaatactgccatactgccctaatgcctaatgattatgtattctcagcatgtctgcaaagtactgctgatttctggagaataatttttctttagtaaacttcacttaagtcgtcatgtgtattctctcaaaatggtatcctaacctaatggagctaaaagacaccccttgtttttataacaagcagttactgaggcccaggaaggggagaagtccctggcttgtgagatgatcaccattagaactcaggcctgggccagtgccttttcatgcttctcagatccttccaaagaataatgaagattataaccgcttttagcaattgtaataaacccagaaatagaaagctttttggttagagtactggtagaagtttggcgggagagataatttttacaaaatttgtaaatacctgccaattctatatactaggcaaggtctctggccttgtaaaacccctcaaggttacaactttggtggcccacactaatagttacccactgaggccctctccgggtgaacattgagcactagaggaagcccctctgcttgggcaggactgggcgtggtgcagagtaggagcggtgatactgtggattctgggcaggtggagatggccagtgatgtccaataaaggacactggagggagcagtgtgagtaaaggccctgagggcattcatgttcagggagggttgctgcccactggcttgcttggcacacaggagagtgggtattcctgccttagtaactttatgtaaacaagtatttcctcagtctgttcctctcaaactgcctgctctggcacattcagaatgtcacagaactcacctggatgcattcagccccttgcctaaaggtgacagtgcatctccttccccaccccacccctcataccactgaagcacctgtcagactggcccagtctgtgggcaaggagcctagagagggcttagtttcagcttgaaaggagctgggatttaccaagaagcaaatgagagacgaggattgcaacaactgtgccatttccccagcttcagctgactcctgtatattgactgtgccttcagactcatccgtaagtgaccccaggctggcctctcccacatcacagtaagaattccacacaccatacaacttggaaagaggctccagctgaaggaagccccacacttctttcaagtttttcttagtcttctcttcttggcaaagagtaccttttgtttcttctaattatgtaactattggtttagtaaatattcacccattcagtcaccctgtaagtggcaggcactgtttacagggacacaggaaggaataaaaacttgcaggcaccttggagcttgcattctattgaagaggtaatggaagttgggatagcagctaaactatgctggtattggccaggcgcagtggctcacacctgtaatcccagcactttggaggccaaggtgggcagatcatgaagtcaggagatcgagaccatcctggctaacatggtgaaaccccgtctctactaaaagtaaaaaaaaaaattagccaggtgtggtggcgggcgcctgtagtcccagctacttgggaggctgaggcaggagaatggtgtgaacccaggaggcgaagattgcagtgagccgagatggcaccactgcactccagcctgggtgacagagcgagactctgtctcagaaaaaaaaaatatgctggtagttttgattcaagatggcctttggagcccatgatttaggtctcgtacccaccaaggtctactggaaaacatcaggctctcctgctatagacccatagggagagctgcagccgagagggggagctgaagagaagtgccccttctgtgtcctgtcagcctcatccttccgcaaggaccagttgctgtgccactccattcacttgctgcaagactggaggtttttcctcaggtgttgagcacctggtttacaagatgtcagcatcttgatgcctgagaccatcaaggcaagtctctgaacagggcttaccttagagtaaggcttagaagaggccgtaaagtcagtctcagctccgtggctctgcagagctttgggacatgtgaattcttaaaaacaagactattgtacagttactatatgcatgcagtataaaattataaccttggaaaatcctagctagctgttgagctaattccataaagtaatcagctcctgagttctgcagtggtaataataatcagcataatgagtaaacactgtgtgtgccaggcagcgtctcatttgatccttgtgataatcttgtaagtactgattttctcccttctttaaacaaagttttttttttttttttagagagggtctcactatgttgcccaggctagtcttgaattc

SEQ ID NO: 19 - DNA, 19 bp, Artificial Sequence
  Primer
gccgccatattatcaacaa

SEQ ID NO: 20 - DNA, 18 bp, Artificial Sequence
  Primer
ctctgcgtctcaggtatt

SEQ ID NO: 21 - DNA, 20 bp, Artificial Sequence
  Primer
ccccagggagttagttttgc

SEQ ID NO: 22 - DNA, 20 bp, Artificial Sequence
  Primer
gatccacggtcctcaaagaa

SEQ ID NO: 23 - DNA, 19 bp, Artificial Sequence
  Primer
cactgcacccagccttatg

SEQ ID NO: 24 - DNA, 20 bp, Artificial Sequence
  Primer
ctgggatgtgaaggaaagga

SEQ ID NO: 25 - RNA, 25 nt, Artificial Sequence
  misc_feature 9: N= a or g or c or t/u; ribozyme
ugcacugangagccuggacgaaacu

What is claimed:

1. An isolated nucleic acid molecule, comprising a sequence of nucleotides that encodes a polypeptide of SEQ ID NO. 2, except that the Ile residue at position 646 of SEQ ID NO: 2 is replaced with Val, Leu or Phe.

2. An isolated nucleic acid molecule of claim 1, wherein the residue at position 646 of SEQ ID NO: 2 is Val.

3. An isolated nucleic acid molecule of claim 1, comprising the sequence of nucleotides set forth as position 138 to position 2126 of SEQ ID NO: 1, except that the nucleotide at position 2073 of SEQ ID NO: 1 is replaced with a nucleotide selected from the group consisting of G, T and C.

4. The nucleic acid molecule of claim 3, wherein the nucleotide at position 2073 of SEQ ID NO: 1 is G.

5. The isolated nucleic acid molecule of claim 2, comprising nucleotides from position 138 to position 2126 of SEQ ID NO: 3.

6. A nucleic acid vector, comprising the nucleic acid molecule of claim 1.

7. A cell containing the nucleic acid vector of claim 6.

8. A cell which comprises a heterologous nucleic acid that encodes the sequence of amino acids set forth in SEQ ID NO: 4.

9. The cell of claim 8, wherein the nucleic acid comprises the sequence of nucleotides set forth from position 138 to position 2126 of SEQ. ID. NO: 3.

10. The isolated nucleic acid molecule of claim 1, which consists essentially of the sequence of nucleotides that encodes the polypeptide of SEQ ID NO: 2.

11. A nucleic acid vector, which comprises the nucleic acid molecule of claim 10.

12. A cell containing the nucleic acid vector of claim 11.

13. The isolated nucleic acid molecule of claim 1, which consists of the sequence of nucleotides that encodes the polypeptide of SEQ ID NO: 2.

14. A nucleic acid vector, which comprises the nucleic acid molecule of claim 13.

15. A cell containing the nucleic acid vector of claim 13.

* * * * *